United States Patent
Sather et al.

(10) Patent No.: US 11,066,475 B2
(45) Date of Patent: Jul. 20, 2021

(54) CHIMERIC ANTIGEN RECEPTORS SPECIFIC FOR B-CELL MATURATION ANTIGEN AND ENCODING POLYNUCLEOTIDES

(71) Applicants: Juno Therapeutics, Inc., Seattle, WA (US); Memorial Sloan Kettering Cancer Center, New York, NY (US)

(72) Inventors: Blythe D. Sather, Seattle, WA (US); Eric L. Smith, New York, NY (US); Rupesh Amin, Seattle, WA (US); Aye Chen, Seattle, WA (US); Kimberly Harrington, Seattle, WA (US); Collin Hauskins, Seattle, WA (US); Erik Hess, Seattle, WA (US); Cyr De Imus, Seattle, WA (US); Jon Jones, Seattle, WA (US); Audrey Olshefsky, Seattle, WA (US); Stefan Ponko, Seattle, WA (US); Ruth Salmon, Seattle, WA (US); Semih Tareen, Seattle, WA (US); Rebecca Wu, Seattle, WA (US); Yan Chen, Seattle, WA (US); Steven M. Shamah, Seattle, WA (US); Csaba Pazmany, Seattle, WA (US); Jui Dutta-Simmons, Seattle, WA (US); Mariana Cota Stirner, Seattle, WA (US); Melissa Works, Seattle, WA (US)

(73) Assignees: Juno Therapeutics, Inc., Seattle, WA (US); Memorial Sloan Kettering Cancer Center, New York, NY (US)

( * ) Notice: Subject to any disclaimer, the term of this patent is extended or adjusted under 35 U.S.C. 154(b) by 149 days.

(21) Appl. No.: 16/178,571

(22) Filed: Nov. 1, 2018

(65) Prior Publication Data

US 2019/0161553 A1   May 30, 2019

Related U.S. Application Data

(60) Provisional application No. 62/580,439, filed on Nov. 1, 2017, provisional application No. 62/580,445, filed on Nov. 1, 2017, provisional application No. 62/582,932, filed on Nov. 7, 2017, provisional application No. 62/582,938, filed on Nov. 7, 2017, provisional application No. 62/596,765, filed on Dec. 8, 2017, provisional application No. 62/596,763, filed on Dec. 8, 2017, provisional application No. 62/614,960, filed on Jan. 8, 2018, provisional application No. 62/614,963, filed on Jan. 8, 2018, provisional application No. 62/665,442, filed on May 1, 2018, provisional application No. 62/665,447, filed on May 1, 2018.

(51) Int. Cl.
| | |
|---|---|
| *A61K 35/17* | (2015.01) |
| *C07K 16/28* | (2006.01) |
| *C07K 14/725* | (2006.01) |
| *A61P 35/00* | (2006.01) |
| *A61K 39/395* | (2006.01) |
| *C07K 14/705* | (2006.01) |
| *C12Q 1/6848* | (2018.01) |
| *A61K 39/00* | (2006.01) |
| *A61K 38/00* | (2006.01) |

(52) U.S. Cl.
CPC .......... *C07K 16/2878* (2013.01); *A61K 35/17* (2013.01); *A61K 39/395* (2013.01); *A61P 35/00* (2018.01); *C07K 14/7051* (2013.01); *C07K 14/70521* (2013.01); *C07K 14/70578* (2013.01); *C12Q 1/6848* (2013.01); *A61K 38/00* (2013.01); *A61K 2039/505* (2013.01); *C07K 2317/524* (2013.01); *C07K 2317/528* (2013.01); *C07K 2317/53* (2013.01); *C07K 2317/565* (2013.01); *C07K 2317/622* (2013.01); *C07K 2317/73* (2013.01); *C07K 2319/02* (2013.01); *C07K 2319/03* (2013.01); *C07K 2319/30* (2013.01); *C07K 2319/33* (2013.01); *C12N 2510/00* (2013.01)

(58) Field of Classification Search
CPC .......... C07K 16/2878; C07K 14/70521; C07K 2319/30; A61K 35/17
USPC ........................................... 424/133.1, 134.1
See application file for complete search history.

(56) References Cited

U.S. PATENT DOCUMENTS

| | | | |
|---|---|---|---|
| 4,235,871 | A | 11/1980 | Papahadjopoulos et al. |
| 4,452,773 | A | 6/1984 | Molday |

(Continued)

FOREIGN PATENT DOCUMENTS

| | | |
|---|---|---|
| CN | 103 492 406 | 1/2014 |
| CN | 107 827 989 | 3/2018 |

(Continued)

OTHER PUBLICATIONS

US 8,252,592 B2, 08/2012, Sadelain (withdrawn)

(Continued)

*Primary Examiner* — Lynn A Bristol
(74) *Attorney, Agent, or Firm* — Morrison and Foerster, LLP

(57) ABSTRACT

Provided herein are chimeric receptors, such as chimeric antigen receptors (CARs), comprising BCMA-binding molecules, such as anti-BCMA antibodies and antigen-binding fragments thereof, such as heavy chain variable ($V_H$) regions and single-chain antibody fragments, and encoding polynucleotides. In some embodiments, the anti-BCMA chimeric receptors specifically bind to BCMA. Among the anti-BCMA-binding molecules are human antibodies, including those that compete for binding to BCMA with reference antibodies, such as a non-human reference antibody. Also provided are genetically engineered cells expressing the CARs and uses thereof such as in adoptive cell therapy.

23 Claims, 37 Drawing Sheets
Specification includes a Sequence Listing.

(56) References Cited

U.S. PATENT DOCUMENTS

| | | |
|---|---|---|
| 4,501,728 A | 2/1985 | Geho et al. |
| 4,690,915 A | 9/1987 | Rosenberg |
| 4,795,698 A | 1/1989 | Owen et al. |
| 4,837,028 A | 6/1989 | Allen |
| 5,019,369 A | 5/1991 | Presant et al. |
| 5,087,616 A | 2/1992 | Myers et al. |
| 5,200,084 A | 4/1993 | Liberti et al. |
| 5,219,740 A | 6/1993 | Miller et al. |
| 5,283,173 A | 2/1994 | Fields et al. |
| 5,424,297 A | 6/1995 | Rubio et al. |
| 5,468,614 A | 11/1995 | Fields et al. |
| 5,504,090 A | 4/1996 | Neely et al. |
| 5,545,627 A | 8/1996 | Jacobson et al. |
| 5,565,566 A | 10/1996 | Olsson |
| 5,670,501 A | 9/1997 | Peck et al. |
| 5,786,360 A | 7/1998 | Neely |
| 5,861,405 A | 1/1999 | Jacobson et al. |
| 5,981,524 A | 11/1999 | Peck et al. |
| 6,040,177 A | 3/2000 | Riddell et al. |
| 6,060,273 A | 5/2000 | Dirks et al. |
| 6,066,642 A | 5/2000 | Jacobson et al. |
| 6,111,090 A | 8/2000 | Gorman et al. |
| 6,117,998 A | 9/2000 | Neely |
| 6,207,453 B1 | 3/2001 | Maass et al. |
| 6,232,297 B1 | 5/2001 | Linden et al. |
| 6,313,131 B1 | 11/2001 | Lawyer |
| 6,322,771 B1 | 11/2001 | Linden et al. |
| 6,326,390 B1 | 12/2001 | Leung et al. |
| 6,410,319 B1 | 6/2002 | Raubitschek et al. |
| 6,451,995 B1 | 9/2002 | Cheung et al. |
| 7,025,962 B1 | 4/2006 | Gorman et al. |
| 7,070,995 B2 | 7/2006 | Jensen |
| 7,083,785 B2 | 8/2006 | Browning et al. |
| 7,132,255 B2 | 11/2006 | Blumberg |
| 7,141,575 B2 | 11/2006 | Gillespie et al. |
| 7,265,209 B2 | 9/2007 | Jensen |
| 7,354,762 B2 | 4/2008 | Jensen |
| 7,405,219 B2 | 7/2008 | Gillespie et al. |
| 7,446,179 B2 | 11/2008 | Jensen et al. |
| 7,446,190 B2 | 11/2008 | Sadelain et al. |
| 7,446,191 B2 | 11/2008 | Jensen |
| 7,605,236 B2 | 10/2009 | Ruben et al. |
| 7,618,632 B2 | 11/2009 | Collins et al. |
| 7,812,135 B2 | 10/2010 | Smith et al. |
| 7,943,743 B2 | 5/2011 | Korman et al. |
| 8,008,449 B2 | 8/2011 | Korman et al. |
| 8,008,450 B2 | 8/2011 | Williams et al. |
| 8,080,554 B2 | 12/2011 | Sitkovsky et al. |
| 8,124,084 B2 | 2/2012 | Lefrancois et al. |
| 8,153,765 B2 | 4/2012 | Park et al. |
| 8,324,353 B2 | 12/2012 | Jensen |
| 8,388,967 B2 | 3/2013 | Smith et al. |
| 8,389,282 B2 | 3/2013 | Sadelain et al. |
| 8,399,645 B2 | 3/2013 | Campana et al. |
| 8,497,118 B2 | 7/2013 | Jensen |
| 8,586,023 B2 | 11/2013 | Shiku et al. |
| 8,591,886 B2 | 11/2013 | Ponath et al. |
| 8,603,477 B2 | 12/2013 | Afar et al. |
| 8,716,301 B2 | 5/2014 | Sitkovsky et al. |
| 8,802,374 B2 | 8/2014 | Jensen |
| 8,883,500 B2 | 11/2014 | Sitkovsky et al. |
| 8,987,279 B2 | 3/2015 | Bamford et al. |
| 9,034,324 B2 | 5/2015 | Kalled et al. |
| 10,562,972 B2 | 2/2020 | Brentjens et al. |
| 10,821,135 B2 | 11/2020 | Brentjens et al. |
| 2002/0131960 A1 | 9/2002 | Sadelain et al. |
| 2003/0170238 A1 | 9/2003 | Gruenberg et al. |
| 2004/0047858 A1 | 3/2004 | Blumberg et al. |
| 2006/0084055 A1 | 4/2006 | Gaiger |
| 2006/0270045 A1 | 11/2006 | Cregg et al. |
| 2007/0116690 A1 | 5/2007 | Yang et al. |
| 2008/0058316 A1 | 3/2008 | Eberhart et al. |
| 2009/0082299 A1 | 3/2009 | Felber et al. |
| 2009/0169562 A1 | 7/2009 | Throsby et al. |
| 2010/0247521 A1 | 9/2010 | Jones et al. |
| 2010/0260748 A1 | 10/2010 | Elkins et al. |
| 2011/0003380 A1 | 1/2011 | Miltenyi et al. |
| 2011/0081311 A1 | 4/2011 | Pavlakis et al. |
| 2012/0039906 A1 | 2/2012 | Olive |
| 2012/0082661 A1 | 4/2012 | Kalled et al. |
| 2012/0141413 A1 | 6/2012 | Pavlakis et al. |
| 2012/0177598 A1 | 7/2012 | Lefrancois et al. |
| 2012/0189622 A1 | 7/2012 | Tesar et al. |
| 2013/0029972 A1 | 1/2013 | Hipskind |
| 2013/0149337 A1 | 6/2013 | Cooper et al. |
| 2013/0156774 A1 | 6/2013 | Kuchroo et al. |
| 2013/0287748 A1 | 10/2013 | June et al. |
| 2013/0336964 A1 | 12/2013 | Rovati et al. |
| 2014/0056922 A1 | 2/2014 | Sitkovsky et al. |
| 2014/0161828 A1 | 6/2014 | Armitage et al. |
| 2014/0193433 A1 | 7/2014 | Borges et al. |
| 2014/0243504 A1 | 8/2014 | Davis et al. |
| 2014/0271618 A1 | 9/2014 | Markel et al. |
| 2014/0271635 A1 | 9/2014 | Brogdon et al. |
| 2014/0377240 A1 | 12/2014 | Sitkovsky et al. |
| 2015/0051266 A1 | 2/2015 | Kochenderfer |
| 2015/0218274 A1 | 8/2015 | Sabatos-Peyton et al. |
| 2015/0259420 A1 | 9/2015 | Triebel et al. |
| 2015/0283178 A1 | 10/2015 | June et al. |
| 2016/0046724 A1 | 2/2016 | Brogdon et al. |
| 2017/0183418 A1 | 6/2017 | Galletto |
| 2018/0018842 A1 | 1/2018 | Imsdah et al. |
| 2018/0118842 A1 | 5/2018 | Brentjens et al. |
| 2018/0200298 A1 | 7/2018 | Jensen et al. |
| 2018/0265593 A1 | 9/2018 | Chen et al. |
| 2018/0360880 A1 | 12/2018 | Brentjens et al. |
| 2020/0078404 A1 | 3/2020 | Ports et al. |
| 2020/0123266 A1 | 4/2020 | Brentjens et al. |
| 2020/0276239 A1 | 9/2020 | Brentjens et al. |
| 2020/0276240 A1 | 9/2020 | Brentjens et al. |
| 2020/0289565 A1 | 9/2020 | Green et al. |
| 2020/0392236 A1 | 12/2020 | Blythe et al. |

FOREIGN PATENT DOCUMENTS

| | | |
|---|---|---|
| CN | 108 239 144 | 7/2018 |
| EP | 0452342 | 10/1991 |
| EP | 1866339 | 12/2007 |
| EP | 1947183 | 7/2008 |
| EP | 2537416 | 12/2012 |
| JP | 2011-178691 | 9/2011 |
| RU | 2009138932 A | 10/2013 |
| WO | WO 1992/008796 | 5/1992 |
| WO | WO 1994/028143 | 12/1994 |
| WO | WO 1999/020758 | 4/1999 |
| WO | WO 1999/040196 | 8/1999 |
| WO | WO 1999/052552 | 10/1999 |
| WO | WO 2000/014257 | 3/2000 |
| WO | WO 2001/003720 | 1/2001 |
| WO | WO 2002/055083 | 7/2002 |
| WO | WO 2005/007190 | 1/2005 |
| WO | WO 2005/055808 | 6/2005 |
| WO | WO 2005/115451 | 12/2005 |
| WO | WO 2006/083289 | 8/2006 |
| WO | WO 2006/099875 | 9/2006 |
| WO | WO 2006/121168 | 11/2006 |
| WO | WO 2007/005874 | 1/2007 |
| WO | WO 2007/133822 | 11/2007 |
| WO | WO 2008/116149 | 9/2008 |
| WO | WO 2008/147482 | 12/2008 |
| WO | WO 2009/072003 | 6/2009 |
| WO | WO 2009/080829 | 7/2009 |
| WO | WO 2010/003118 | 1/2010 |
| WO | WO 2010/019570 | 2/2010 |
| WO | WO 2010/033140 | 3/2010 |
| WO | WO 2010/054007 | 5/2010 |
| WO | WO 2010/077634 | 7/2010 |
| WO | WO 2010/104949 | 9/2010 |
| WO | WO 2010/125571 | 11/2010 |
| WO | WO 2011/028683 | 3/2011 |
| WO | WO 2011/051726 | 5/2011 |
| WO | WO 2011/085103 | 7/2011 |
| WO | WO 2011/090754 | 7/2011 |
| WO | WO 2012/066058 | 5/2012 |

(56) References Cited

FOREIGN PATENT DOCUMENTS

| | | |
|---|---|---|
| WO | WO 2012/079000 | 6/2012 |
| WO | WO 2012/092612 | 7/2012 |
| WO | WO 2012/129514 | 9/2012 |
| WO | WO 2012/143498 | 10/2012 |
| WO | WO 2012/163805 | 12/2012 |
| WO | WO 2013/006490 | 1/2013 |
| WO | WO 2013/039954 | 3/2013 |
| WO | WO 2013/054331 | 4/2013 |
| WO | WO 2013/071154 | 5/2013 |
| WO | WO 2013/072406 | 5/2013 |
| WO | WO 2013/072415 | 5/2013 |
| WO | WO 2013/082366 | 6/2013 |
| WO | WO 2013/123061 | 8/2013 |
| WO | WO 2013/126726 | 8/2013 |
| WO | WO 2013/154760 | 10/2013 |
| WO | WO 2013/166321 | 11/2013 |
| WO | WO 2014/031687 | 2/2014 |
| WO | WO 2014/055668 | 4/2014 |
| WO | WO 2014/059251 | 4/2014 |
| WO | WO 2014/087010 | 6/2014 |
| WO | WO 2014/089335 | 6/2014 |
| WO | WO 2014/134165 | 9/2014 |
| WO | WO 2014/190273 | 11/2014 |
| WO | WO 2014/191128 | 12/2014 |
| WO | WO 2014/210064 | 12/2014 |
| WO | WO 2015/095895 | 6/2015 |
| WO | WO 2015/142675 | 9/2015 |
| WO | WO 2015/158671 | 10/2015 |
| WO | WO 2016/014530 | 1/2016 |
| WO | WO 2016/014789 | 1/2016 |
| WO | WO 2016/046724 | 2/2016 |
| WO | WO 2016/090312 | 6/2016 |
| WO | WO 2016/090320 | 6/2016 |
| WO | WO 2016/090327 | 6/2016 |
| WO | WO 2016/094304 | 6/2016 |
| WO | WO 2016/164580 | 10/2016 |
| WO | WO 2016/210262 | 12/2016 |
| WO | WO 2017/025038 | 2/2017 |
| WO | WO 2017/058754 | 4/2017 |
| WO | WO 2017/087547 | 5/2017 |
| WO | WO 2017/172981 | 10/2017 |
| WO | WO 2017/173256 | 10/2017 |
| WO | WO 2017/222593 | 12/2017 |
| WO | WO 2018/071873 | 4/2018 |
| WO | WO 2018/075820 | 4/2018 |
| WO | WO 2018/085690 | 5/2018 |
| WO | WO 2018/085731 | 5/2018 |
| WO | WO 2018/093591 | 5/2018 |
| WO | WO 2018/102785 | 6/2018 |
| WO | WO 2018/102786 | 6/2018 |
| WO | WO 2018/102787 | 6/2018 |
| WO | WO 2018/175988 | 9/2018 |
| WO | WO 2018/197675 | 11/2018 |
| WO | WO 2018/201056 | 11/2018 |
| WO | WO 2018/204427 | 11/2018 |
| WO | WO 2019/089969 | 5/2019 |
| WO | WO 2019/090003 | 5/2019 |
| WO | WO 2019/090364 | 5/2019 |
| WO | WO 2020/092848 | 5/2020 |
| WO | WO 2020/092854 | 5/2020 |

OTHER PUBLICATIONS

Tai et al. (Immunotherapy. Nov. 2015; 7(11): 1187-1199).*
U.S. Appl. No. 16/760,411, filed Nov. 1, 2018, by Sather et al. (Copy not provided). (Copy not submitted herewith pursuant to the waiver of 37 C.F. R. § 1.98(a)(2)(iii) issued by the Office on Sep. 21, 2004).
U.S. Appl. No. 16/761,770, filed Nov. 6, 2018, by Green et al. (Copy not provided). (Copy not submitted herewith pursuant to the waiver of 37 C.F. R. § 1.98(a)(2)(iii) issued by the Office on Sep. 21, 2004).
U.S. Appl. No. 16/844,610, filed Apr. 9, 2020, by Brentjens et al. (Copy not provided). (Copy not submitted herewith pursuant to the waiver of 37 C.F. R. § 1.98(a)(2)(iii) issued by the Office on Sep. 21, 2004).
U.S. Appl. No. 16/844,759, filed Apr. 9, 2020, by Brentjens et al. (Copy not provided). (Copy not submitted herewith pursuant to the waiver of 37 C.F. R. § 1.98(a)(2)(iii) issued by the Office on Sep. 21, 2004).
Barderas et al., "Affinity maturation of antibodies assisted by in silico modeling," Proc. Natl. Acad. Sci. U.S.A. (2008) 105(26):9029-34.
Brown et al., "Tolerance of single, but not multiple, amino acid replacements in antibody VH CDR2: a means of minimizing B cells wastage from somatic hypermutation?" J. Immunol. (1996) 156(9):3285-91.
Caron et al., "Engineered Humanized Dimeric Forms of IgG are More Effective Antibodies," J Exp. Med 176: 1191-95 (1992).
Casset et al."A peptide mimetic of an anti-CD4 monoclonal antibody by rational design." BBRC, 307: 198-205 (2003).
Chen et al., "Selection and analysis of an optimized anti-VEGF antibody: Crystal structure of an affinity-matured Fab in complex with antigen," J. Mol. Bio. (1999) 293:865-81.
Creative BioMart, Anti-Human TNFRSF17 scFv Stable Cell Line-CHO. (Aug. 30, 2013) [according to the properties of the posted document] (Retrieved from the Internet Mar. 23, 2016: <http://www.creativebiomart.net/pdf/CSC-P0544,TNFRSF17.pdt>); p. 1.
De Pascalis et al., "Grafting of "Abbreviated" Complementarity-Determining Regions Containing Specificity-Determining Residues Essential for Ligand Contact to Engineer a Less Immunogenic Humanized Monoclonal Antibody," The Journal of Immunology 169:3076-84 (2002).
Dondelinger et a., "Understanding the Significance and Implications of Antibody Numbering and Antigen-Binding Surface/Residue Definition," Fronts. Immunol. 9 (2018):1-15.
Fernandez De Larrea et al., "Defining an optimal dual-targeted CAR T cell therapy approach simultaneously targeting BCMA and GPRC5D to prevent BCMA-escape driven relapse in multiple myeloma," Blood Cancer Discovery (2020) 1:1-9.
Gershoni et al., "Epitope mapping—The first step in developing epitope-based vaccines," Biod, Adis International Ltd, 21 (3 ): 145-56 (2007).
Kapustin et al., "Cryptic splice sites and split genes," Nucleic Acids Res. (2011) 39(14):5837-44.
Kochenderfer et al., "Adoptive transfer of syngeneic T cells transduced with a chimeric antigen receptor that recognizes murine CD19 can eradicate lymphoma and normal B cells", Blood (2010) 116(19):3875-86.
Koyko et al., "Immunology," translation from English, edited by N.B. Serebryanaya, Mosow, "Akademiya," 2008, p. 37 (in Russian).
Lamminmaki et al. "Crystal Structure of a Recombinant Anti-estradiol Fab Fragment in Complex with 17β-Estradiol" JBC 276:36687-94 (2001).
Maynard et al., "Protection against anthrax toxin by recombinant antibody fragments correlates with antigen affinity," Nature Biotech. (2002) 20(6):597-601.
Meibohm (Keuester), Pharmacokinetics and Pharmacodynamics of Biotech Drugs, Wiley-VHC (2006) Chapter 3:45-91.
Nasonov et al., "Belimumab: progress v lechenii sistemnoj krasnoj volchanki", Nauch-praktich revmatol, 2012, 54(5):13-19. (English translation).
Ozhegov et al. "Dictionary of a Russian Language: 80,000 words and phraseological expressions," 4th ed. Supplemented, Moscow, (2006): p. 375.
Padlan et al. "Structure of an antibody-antigen complex: crystal structure of the HyHEL-10 Fab-lysozyme complex" PNAS 86:5938-42 (1989).
Ramadoss et al., "An Anti-B Cell Maturation Antigen Bispecific Antibody for Multiple Myeloma," J. Am. Chem. Soc., 137:5288-91 (2015).
Rudikoff et al., "Single amino acid substitution altering antigen-binding specificity," ONAS (1982) 79(6):1979-83.
Vajdos et al. "Comprehensive functional maps of the antigen-binding site of an anti-ErbB2 antibody obtained with shotgun scanning mutagenesis." J. Mol. Biol. 320, 415-28 (2002).

(56) References Cited

OTHER PUBLICATIONS

White et al. "Antibody-Targeted Immunotherapy for Treatment of Malignancy" Ann. Rev. Med. 52:125-45 (2001).
Winkler et al, "Changing the antigen binding specificity by single point mutations of an anti-p24 (HIV-1) antibody," J. Immunol. (2000) 165(8):4505-14.
Wu et al. "Humanization of a murine monoclonal antibody by simultaneous optimization of framework and CDR residues." J. Mol. Biol. (1999) 294:151-62.
Abramson et al., "CR Rates in Relapsed/Refractory (R/R) Aggressive B-NHL Treated With the CD19-Directed CAR T Cell Product JCAR017 (Transcend NHL 001)," ASCO. 2017. Abstract 7513. Published on May 20, 2017.
Abramson et al., "High durable CR rates and preliminary safety profile for JCAR017 in R/R aggressive b-NHL (Transcend NHL 001 Study): A defined composition CD19-directed CAR T-cell product with potential for outpatient administration," ASCO 2018. Abstract 120. Published on Feb. 26, 2018.
Abramson et al., "High Durable CR Rates in Relapsed/Refractory (R/R) Aggressive B-NHL treated with the CD-19Directed CAR T Cell Product JCAR017 (Transcend NHL. 001): Defined Composition Allows for Dose-Finding and Definition of Pivotal Cohort," Blood (2017) 130:581.
Adams et al., "Development of KITE-585 a fully human BCMA CAR T-cell therapy for the treatment of multiple myeloma," AACR Annual Meeting 2017. Abstract 4979. Presented on Apr. 4, 2017.
Adams et al., "Selectivity and specificity of engineered T cells expressing KITE-585 a chimeric anitgen receptor targeting B-cell maturation antigen BCMA," AACR Annual Meeting 2017. Abstract 2135. Presented on Apr. 3, 2017.
Al-Hujaily et al., "Development of novel immunotherapies for multiple myeloma," Int J Mol Sci (2016) 17:1506.
Ali et al., "T cells expressing an anti-B-cell maturation antigen chimeric antigen receptor cause remissions of multiple myeloma," Blood (2016) 128(13):1688-1700.
Allard et al., "Targeting CD73 Enhances the Antitumor Activity of Anti-PD-1 and Anti-CTLA-4 mAbs," Clin Cancer Res (2013) 19(20):5626-5635.
Al-Lazikani et al., "Standard conformations for the canonical structures of immunoglobulins," JMB (1997) 273:927-948.
Alonso-Camino et al., "CARbodies: Human Antibodies Against Cell Surface Tumor Antigens Selected From Repertoires Displayed on T Cell Chimeric Antigen Receptors," Mol Ther Nucl Acids (2013) 2: e93.
Alyea et al., "Toxicity and efficacy of defined doses of CD4(+) donor lymphocytes for treatment of relapse after allogeneic bone marrow transplant," Blood (1998) 91(10):3671-3680.
Anderson, "Oncogenomics to target myeloma in the bone marrow microenvironment," Clin Cancer Res (2011)17(6):1225-1233.
Beavis et al., "Blockade of A2A receptors potently suppresses the metastasis of CD73+ tumors," PNAS (2013) 110(36):14711-14716.
Benson et al., "CS1-directed monoclonal antibody therapy for multiple myeloma," J Clin Oncol (2012) 30(16):2013-2015.
Berdeja et al. First-in-human multicenter study of bb2121 anti-BCMA CAR T-cell therapy for relapsed/refractory multiple myeloma: Updated results. Journal of Clinical Oncology. 2017;35(15_suppl):3010-3010.
Berdeja et al., "First-in-human multicenter study of bb2121 anti-BCMA CAR T cell therapy for relapsed/refractory multiple myeloma: updated results," ASCO 2017. Abstract 3010. Presented Jun. 5, 2017.
Berger et al., "Phase I safety and pharmacokinetic study of CT-011, a humanized antibody interacting with PD-1, in patients with advanced hematologic malignancies," Clin Cancer Res (2008) 14(10):3044-3051.
Bertilaccio et al., "Low-Dose Lenalidomide Improves CAR-Based Immunotherapy in CLL by Reverting T-Cell Defects In Vivo," Blood (2013) 122:4171.
Boris-Lawrie et al., "Recent advances in retrovirus vector technology," Cur. Opin. Genet. Develop. (1993) 3:102-109.

Brash et al., "Strontium phosphate transfection of human cells in primary culture: stable expression of the simian virus 40 large-T-antigen gene in primary human bronchial epithelial cells," Mol. Cell Biol. (1987) 7: 2031-2034.
Brentjens et al., "CD19-targeted T cells rapidly induce molecular remissions in adults with chemotherapy-refractory acute lymphoblastic leukemia," Sci Transl Med. (2013) 5(177):177ra38.
Brummelkamp et al., "A system for stable expression of short interfering RNAs in mammalian cells," Science (2002) 296(5567):550-553.
Burns et al., "Vesicular stomatitis virus G glycoprotein pseudotyped retroviral vectors: concentration to very high titer and efficient gene transfer into mammalian and nonmammalian cells," Proc. Natl. Acad. Sci. USA (1993) 90:8033-8037.
Carlens et al., "Ex vivo T lymphocyte expansion for retroviral transduction: influence of serum-free media on variations in cell expansion rates and lymphocyte subset distribution," Exp Hematol (2000) 28(10): 1137-46.
Carpenter et al., "B-cell maturation antigen is a promising target for adoptive T-cell therapy of multiple myeloma," Clin Cancer Res (2013) 19(8):2048-2060.
Carroll et al., "Targeting the molecular basis for tumour hypoxia," Expert Rev Mol Med (2005) 7(6):1-16.
Cavalieri et al., "Human T lymphocytes transduced by lentiviral vectors in the absence of TCR activation maintain an intact immune competence," Blood (2003) 102(2): 497-505.
Chicaybam et al., "An efficient low cost method for gene transfer to T lymphocytes," PLoS ONE (2013) 8(3): e60298.
Cho et al., "Human mammalian cell sorting using a highly integrated micro-fabricated fluorescence-activated cell sorter (microFACS)," Lab Chip (2010) 10: 1567-1573.
Chu et al., "CS1-specific chimeric antigen receptor (CAR)-engineered natural killer cells enhance in vitro and in vivo antitumor activity against human multiple myeloma," Leukemia (2014) 28(4):917-927.
Chung, "Role of Immunotherapy in Targeting the Bone Marrow Microenvironment in Multiple Myeloma: An Evolving Therapeutic Strategy," Pharmacotherapy (2017) 37(1):129-143.
Clackson et al., "Making antibody fragments using phage display libraries," Nature (1991) 352:624-628.
Claudio et al., "A molecular compendium of genes expressed in multiple myeloma," Blood (2002) 100(6):2175-2186.
Clinical Trial Identifier NCT02215967, "Study of T Cells Targeting B-Cell Maturation Antigen for Previously Treated Multiple Myeloma," Retrieved on https://clinicaltrials.gov/ct2/show/NCT02215967. Retrieved on Feb. 8, 2019.
Clinical Trial Identifier NCT02546167, "CART-BCMA Cells for Multiple Myeloma," Retrieved on https://clinicaltrials.gov/ct2/show/NCT02546167. Retrieved on Oct. 22, 2018.
Clinical Trial Identifier NCT02658929, "Study of bb2121 in Multiple Myeloma," Retrieved on https://clinicaltrials.gov/ct2/show/NCT02658929. Retrieved on Oct. 22, 2018.
Clinical Trial Identifier NCT03070327, "BCMA Targeted CAR T Cells With or Without Lenalidomide for the Treatment of Multiple Myeloma," Retrieved on https://clinicaltrials.gov/ct2/show/NCT03070327. Retrieved on Feb. 8, 2019.
Clinical Trial Identifier NCT03430011, "Study Evaluating the Safety and Efficacy of JCARH125 in Subjects With Relapsed and_or Refractory Multiple Myeloma (EVOLVE)," Retrieved on https://clinicaltrials.gov/ct2/show/NCT03430011. Retrieved on Oct. 30, 2018.
Clinical Trial Identifier NCT03436771, "Long-term Follow-up Study for Patients Previously Treated With a Juno CAR T-Cell Product," Retrieved on https://clinicaltrials.gov/ct2/show/NCT03436771. Retrieved on Feb. 7, 2019.
Cohen et al., "B-cell Maturation Antigen (BMCA)-specific chimeric antigen receptor T cells (CART-BCMA) for multiple myeloma (MM): initial safety and efficacy from a phase I study," Blood (2016) 128:1147.
Cohen et al., "CAR-T Cell Therapy for Myeloma: State of the Art and Perspective on a Possible Cure," Lymphoma and Myeloma 2018. Presentation. Presented on Oct. 18, 2018.

(56) References Cited

OTHER PUBLICATIONS

Cooper et al., "T-cell clones can be rendered specific for CD19: toward the selective augmentation of the graft-versus-B-lineage leukemia effect," Blood. (2003) 101:1637-1644.
Coquery et al., "Regulatory roles of the tumor necrosis factor receptor BCMA," Crit Rev Immunol (2012) 32(4):287-305.
Cornell et al., "Evolving paradigms in the treatment of relapsed/refractory multiple myeloma: increased options and increased complexity," Bone Marrow Transplant (2016) 51(4):479-491.
Cronstein et al., "Adenosine modulates the generation of superoxide anion by stimulated human neutrophils via interaction with a specific cell surface receptor," Ann N Y Acad Sci (1985) 451:291-301.
Cronstein et al., "Engagement of adenosine receptors inhibits hydrogen peroxide (H2O2-) release by activated human neutrophils," Clin Immunol Immunopathol (1987) 42(1):76-85.
Darling et al., "Kinetic Exclusion Assay Technology: Characterization of Molecular Interactions," Assay Drug Dev (2004) 2:647-657.
Davila et al., "CD19 CAR-targeted T cells induce long-term remission and B Cell Aplasia in an immunocompetent mouse model of B cell acute lymphoblastic leukemia," PLoS ONE (2013) 8(4): e61338.
De Felipe et al., "Skipping the co-expression problem: the new 2A "CHYSEL" technology," Genetics Vaccines and Therapy (2004) 2:13.
De Felipe et al., "Targeting of proteins derived from self-processing polyproteins containing multiple signal sequences," Traffic (2004) 5(8):616-626.
Desmet et al., "Human Splicing Finder: an online bioinformatics tool to predict splicing signals," Nucleic Acids Res (2009) 37(9):e67.
Dimopoulos et al. "Current treatment landscape for relapsed and/or refractory multiple myeloma," Nat Rev Clin Oncol (2015) 12:42-54.
Eden et al., "Analysis and recognition of 5' UTR intron splice sites in human pre-mRNA," Nucl Acids Res (2004) 32(3):1131-1142.
Fan et al., "Durable remissions with BCMA specific chimeric antigen receptor (CAR)-modified T cells in patients with refractory/relapsed multiple myeloma," ASCO 2017. Abstract LBA3001. Presented Jun. 5, 2017.
Fecteau et al., "Lenalidomide inhibits the proliferation of CLL cells via a cereblon/p21WAF1/Cip1-dependent mechanism independent of functional p53," Blood (2014) 124:1637-1644.
Fedorov et al., "PD-1- and CTLA-4-based inhibitory chimeric antigen receptors (iCARs) divert off-target immunotherapy responses," Sci. Transl. Medicine (2013) 5(215).
Flatman et al., "Process analytics for purification of monoclonal antibodies," J. Chromatogr. (2007) B 848:79-87.
Fonseca et al., "International Myeloma Working Group molecular classification of multiple myeloma: spotlight review," Leukemia (2009) 23(12):2210-2221.
Food and Drug Administration, "Guidance for Industry: Considerations for the Design of Early-Phase Clinical Trials of Cellular and Gene Therapy Products," Dated Jun. 2015.
Gantke et al., "AFM26 is a novel and highly potent BCMA CD16A directed bispecfic antibody for high affinity NK-cell engagement in multiple myeloma," ASCO 2017. Abstract 8045. Presented Jun. 5, 2017.
Garfall et al., "Immunotherapy with chimeric antigen receptors for multiple myeloma," Discov Med (2014) 17(91):37-46.
Gerecke et al., "The Diagnosis and Treatment of Multiple Myeloma," Dtsch Arztebl Int (2016) 113(27-28):470-476.
Gerngross et al, "Advances in the production of human therapeutic proteins in yeasts and filamentous fungi," Nat. Biotech. (2004) 22:1409-1414.
Geyer et al., "Review: Current clinical applications of chimeric antigen receptor (CAR) modified T cells," Cytotherapy (2016) 18:1393-1409.
Ghermezi et al., "Serum B-cell maturation antigen: a novel biomarker to predict outcomes for multiple myeloma patients," Haematologica (2017) 102(4):785-95.
Gieseler et al., "Cellular resistance mechanisms with impact on the therapy of multiple myeloma," Leukemia (1998) 12(7):1009-1012.
Gildener-Leapman et al., "Promising systemic immunotherapies in head and neck quamous cell carcinoma," Oral Oncol (2013) 49(12):1089-1096.
Godin et al., "Microfluidics and photonics for Bio-System-on-a-Chip: a review of advancements in technology towards a microfluidic flow cytometry chip," J Biophoton. (2008) 1(5):355-376.
Granell et al., "Prognostic impact of circulating plasma cells in patients with multiple myeloma: implications for plasma cell leukemia definition," Haematologica (2017) 102(6):1099-1104.
Green et al., "Fully Human BCMA Targeted CAR T cells Administered in a Defined Composition: First-in Human Treatment Demonstrates Clinical Potency at Low Doses in Advanced Stage High Risk Multiple Myeloma," ASH 2018. Abstract 1011. Presented on Dec. 3.
Green et al., "Fully Human BCMA Targeted CAR T cells Administered in a Defined Composition: First-in Human Treatment Demonstrates Clinical Potency at Low Doses in Advanced Stage High Risk Multiple Myeloma," ASH 2018. Presentation. Presented on Dec. 3, 2018.
Grossman et al., "Concomitant regulation of T-cell activation and homeostasis," Nat Rev Immunol (2004) 4(5):387-395.
Harrington et al., "Development of JCARH125: Optimization of a Fully Human Anti-BCMA CAR for Use in the Treatment of Multiple Myeloma," ASH 2017. Abstract. Blood (2017) 130:1813.
Harrington et al., "JCARH125: Development of an Optimized Fully Human Anti-BCMA CAR for the Treatment of Multiple Myeloma," ASH 2017. Poster 1813. Presented on Dec. 9-12.
Hausler et al., "Anti-CD39 and anti-CD73 antibodies A1 and 7G2 improve targeted therapy in ovarian cancer by blocking adenosine-dependent immune evasion," Am J transl Res (2014) 6(2):129-139.
Hermans et al., "The VITAL assay: a versatile fluorometric technique for assessing CTL- and NKT-mediated cytotoxicity against multiple targets in vitro and in vivo," J. Immunological Methods (2004) 285(1): 25-40.
Hershfield, "PEG-ADA: an alternative to haploidentical bone marrow transplantation and an adjunct to gene therapy for adenosine deaminase deficiency," Hum Mutat (1995) 5(2):107-112.
Honegger A and Plückthun A, "Yet another numbering scheme for immunoglobulin variable domains: an automatic modeling and analysis tool," J Mol Biol, (2001) 8;309(3):657-70.
Huang et al., "DNA transposons for modification of human primary T lymphocytes," Methods Mol Biol (2009) 506: 115-126.
Hudecek et al., "Receptor affinity and extracellular domain modifications affect tumor recognition by ROR1-specific chimeric antigen receptor T cells," Clin. Cancer Res. (2013) 19:3153.
Hudecek et al., "The nonsignaling extracellular spacer domain of chimeric antigen receptors is decisive for in vivo antitumor activity," Cancer Immunol Res (2015) 3(2):125-135.
Jensen et al., "Design and implementation of adoptive therapy with chimeric antigen receptor-modified T cells," Immunological reviews (2014) 257(1):127-144.
Jin et al., "CD73 on tumor cells impairs antitumor T-cell responses: a novel mechanism of tumor-induced immune suppression," Cancer Res (2010) 70(6):2245-2255.
Johnston, et al., "Biolistic transformation: microbes to mice," Nature (1990) 346: 776-777.
Juno Corporate Presentation. Retrieved on http://ir.junotherapeutics.com. Retrieved on Jan. 2018.
Juno Corporate Presentation. Retrieved on http://ir.junotherapeutics.com. Retrieved on Sep. 2017.
Klebanoff et al., "Sorting through subsets: which T-cell populations mediate highly effective adoptive immunotherapy?," J Immunother. (2012) 35(9): 651-660.
Kochenderfer et al., "Construction and preclinical evaluation of an anti-CD19 chimeric antigen receptor," J. Immunotherapy (2009) 32(7): 689-702.
Koste et al., "T-cell receptor transfer into human T cells with ecotropic retroviral vectors," Gene Therapy (2014) 21: 533-538.
Kumar et al., "International Myeloma Working Group consensus criteria for response and minimal residual disease assessment in multiple myeloma," Lancet Oncol (2016) 17(8):e328-e346.

(56) References Cited

OTHER PUBLICATIONS

Kunkele et al., "Functional Tuning of CARs Reveals Signaling Threshold above Which CD8ρ CTL Antitumor Potency Is Attenuated due to Cell Fas-FasL-Dependent AICD," Cancer Immunol Res (2015) 3(4):368-379.
Kuramitsu et al., "Lenalidomide enhances the function of chimeric antigen receptor T cells against the epidermal growth factor receptor variant III by enhancing immune synapses," Cancer Gene Therapy (2015) 22(10):487-495.
Laurent et al., "γ-Secretase directly sheds the survival receptor BCMA from plasma cells," Nat Commun (2015) 6:7333.
Lefranc et al., "IMGT unique numbering for immunoglobulin and T cell receptor variable domains and Ig superfamily V-like domains," Dev Comp Immunol (2003) 27(1):55-77.
Leone et al., "A2aR antagonists: Next generation checkpoint blockade for cancer immunotherapy," Comput Struct Biotechnol J. (2015) 13:265-272.
Li et al., "Optimization of humanized IgGs in glycoengineered Pichia pastoris," Nat. Biotech. (2006) 24:210-215.
Lim et al., "Anti-CD20 monoclonal antibodies: historical and future perspectives," Haematologica (2010) 95(1):135-143.
Lipson et al., "Durable cancer regression off-treatment and effective reinduction therapy with an anti-PD-1 antibody," Clin Cancer Res (2013) 19(2):462-468.
Liu et al., "Inclusion of Strep-tag II in design of antigen receptors for T-cell immunotherapy," Nat Biotechnol (2016) 34(4):430-434.
Lupton S. D. et al., "Dominant positive and negative selection using a hygromycin phosphotransferase-thymidine kinase fusion gene," Mol. And Cell Biol. (1991) 11:6.
MacCallum et al., "Antibody-antigen interactions: Contact analysis and binding site topography," J. Mol. Biol. (1996) 262, 732-745.
Mailankody et al., "JCARH125, Anti-BCMA CAR T-cell Therapy for Relapsed_Refractory Multiple Myeloma_ Initial Proof of Concept Results from a Phase 1_2 Multicenter Study (EVOLVE)," ASH 2018 Presentation. Presented on Dec. 3, 2018.
Mailankody et al., "JCARH125, Anti-BCMA CAR T-cell Therapy for Relapsed_Refractory Multiple Myeloma_ Initial Proof of Concept Results from a Phase 1_2 Multicenter Study (EVOLVE)," ASH 2018. Abstract 957. Presented on Dec. 3, 2018.
Manuri et al., "piggyBac transposon/transposase system to generate CD19-specific T cells for the treatment of B-lineage malignancies," Hum Gene Ther (2010) 21(4): 427-437.
Martin et al., "Modeling antibody hypervariable loops: a combined algorithm," Proc Natl Acad Sci U S A. Dec. 1989;86(23):9268-72.
Maus et al., "Zoom Zoom: racing CARs for multiple myeloma," Clinical cancer research (2013) 19(8):1917-1919.
Menzies et al., "New combinations and immunotherapies for melanoma: latest evidence and clinical utility," Ther Adv Med Oncol (2013) 5(5):278-285.
Miller et al., "Improved retroviral vectors for gene transfer and expression," BioTechniques (1989) 7:980-990.
Miller et al., "Retrovirus packaging cells," Human Gene Therapy (1990) 1:5-14.
Miyagishi et al., "U6 promoter-driven siRNAs with four uridine 3' overhangs efficiently suppress targeted gene expression in mammalian cells" Nat Biotechnol (2002) 20(5):497-500.
Monney et al., "Th1-specific cell surface protein Tim-3 regulates macrophage activation and severity of an autoimmune disease," Nature (2002) 415(6871):536-541.
Mullen et al., "Transfer of the bacterial gene for cytosine deaminase to mammalian cells confers lethal sensitivity to 5-fluorocytosine: a negative selection system," Proc. Natl. Acad. Sci. USA (1992) 89:33.
Naymagon et al., "Novel agents in the treatment of multiple myeloma: a review about the future," J Hematol Oncol (2016) 9(1):52.
Nelson., "CD20+ B cells: the other tumor-infiltrating lymphocytes," J Immunol. (2010) 185(9):4977-4982.
Neelapu et al. Chimeric antigen receptor T-cell therapy—assessment and management of toxicities. Nat Rev Clin Oncol (2018)15(1):47-62.
Novak et al., "Expression of BCMA, TACI, and BAFF-R in multiple myeloma: a mechanism for growth and survival," Blood (2004)103(2):689-694.
Ohta et al., "A2A adenosine receptor protects tumors from antitumor T cells," PNAS U.S.A. (2006) 103(35):13132-13137.
Oken et al., "Toxicity and response criteria of the Eastern Cooperative Oncology Group," Am J Clin Oncol (1982) 5(6):649-655.
Otahal et al., "Lenalidomide enhances antitumor functions of chimeric antigen receptor modified T cells," Oncoimmunology (2015) 5(4):e1115940.
Ott et al., "CTLA-4 and PD-1/PD-L1 Blockade: New Immunotherapeutic Modalities with Durable Clinical Benefit in Melanoma Patients," Clin Cancer Res (2013) 19(19):5300.
Palumbo et al., "Multiple myeloma," N Engl J Med (2011) 364(11):1046-1060.
Pardoll, "The blockade of immune checkpoints in cancer immunotherapy," Nature Reviews Cancer (2012) 12:252-264.
Park et al., "Treating cancer with genetically engineered T cells," Trends Biotechnol. (2011) 29(11): 550-557.
Pertea et al., "GeneSplicer: a new computational method for splice site prediction," Nucl Acids Res (2001) 29(5):1185-1190.
Pinna et al., "Novel investigational adenosine A2A receptor antagonists for Parkinson's disease," Expert Opin Investig Drugs (2009) 18:1619-1631.
Pinthus et al., "Adoptive immunotherapy of prostate cancer bone lesions using redirected effector lymphocytes," J Clin Invest (2004) 114(12):1774-1781.
Portolano et al., "Lack of promiscuity in autoantigen-specific H and L chain combinations as revealed by human H and L chain "roulette"," J. Immunol. (1993) 150:880-887.
Rajkumar et al., "Multiple myeloma: 2012 update on diagnosis, risk-stratification, and management," Am J Hematol (2012) 87(1):78-88.
Rajkumar et al., "Guidelines for determination of the number of prior lines of therapy in multiple myeloma," Blood (2015) 126(7):921-922.
Rajkumar SV. "Updated Diagnostic criteria and staging for mutliple myeloma," ASCO Educational Book (2016) e418.
Raza et al., "Optimizing current and emerging therapies in multiple myeloma: a guide for the hematologist," Ther Adv Hematol (2017) 8(2):55-70.
Reese et al., "Improved splice site detection in Genie," J Comput Biol (1997) 4(3):311-323.
Richardson et al., "Lenalidomide in multiple myeloma," Expert review of anticancer therapy (2006) 6(8):1165-1173.
Riddell et al., "Phase I study of cellular adoptive immunotherapy using genetically modified CD8+ HIV-specific T cells for HIV seropositive patients undergoing allogeneic bone marrow transplant," Human Gene Therapy (1992) 3:319-338.
Robert et al., "What is the role of cytotoxic T lymphocyte-associated antigen 4 blockade in patients with metastatic melanoma?," Oncologist (2009) 14(8):848-861.
Roberts et al., "Inhibition by adenosine of reactive oxygen metabolite production by human polymorphonuclear leucocytes," Biochem J (1985) 227(2):669-674.
Rosenberg, et al., "Cell transfer immunotherapy for metastatic solid cancer—what clinicians need to know," Nat Rev Clin Oncol. (2011) 8(10):577-85.
Rossi et al., "Polyfunctional anti-CD19 CAR T cells determined by single-cell multiplex proteomics associated with clinical activity in patients with advanced non-Hodgkin's lymphoma," AACR Annual Meeting 2017. Abstract 2990. Presented on Apr. 3, 2017.
Ryan et al., "Antibody targeting of B-cell maturation antigen on malignant plasma cells," Molecular cancer therapeutics (2007) 6(11):3009-3018.
Sadelain et al., "The basic principles of chimeric antigen receptor design," Cancer Discov. (2013) 3(4): 388-398.
Sanchez et al. "Serum B-cell maturation antigen is elevated in multiple myeloma and correlates with disease status and survival," Br J Haematol (2012) 158(6):727-38.

(56) References Cited

OTHER PUBLICATIONS

Sanchez et al., "Soluble BCMA in myeloma serum binds its ligands BAFF and prevents normal antibody production in multiple myeloma patients," Blood (2015) 126:1799.
Saxonov et al., "EID: the Exon-Intron Database—an exhaustive database of protein-coding intron-containing genes," Nucl Acids Res (2000) 28(1):185-190.
Scatchard, "The attractions of proteins for small molecules and ions," Annals of the New York Academy of Sciences (1949) 51(4):660-672.
Scarpa et al., "Characterization of recombinant helper retroviruses from Moloney-based vectors in ecotropic and amphotropic packaging cell lines," Virology (1991) 180:849-852.
Schrier et al., "The effects of adenosine agonists on human neutrophil function," J Immunol (1986) 137(10):3284-3289.
Seckinger et al. "Target Expression, Generation, Preclinical Activity, and Pharmacokinetics of the BCMA-T Cell Bispecific Antibody EM801 for Multiple Myeloma Treatment," Cancer Cell (2017) 31(3):396-410.
Sharma et al., "Efficient sleeping beauty DNA transposition from DNA minicircles," Molec Ther Nucl Acids (2013) 2, e74.
Sitkovsky et al., "Hostile, hypoxia-A2-adenosinergic tumor biology as the next barrier to overcome for tumor immunologists," Cancer Immunol Re (2014) 2(7):598-605.
Smith et al., "CAR T Cell Therapy Targeting G Protein-Coupled Receptor Class C Group 5 Member D (GPRC5D), a Novel Target for Immunotherapy of Myelom," ASH Annual Meeting 2018. Presentation. Presented on Dec. 3, 2018.
Smith et al., "CAR T Cell Therapy Targeting G Protein-Coupled Receptor Class C Group 5 Member D (GPRC5D), a Novel Target for the Immunotherapy of Multiple Myeloma," ASH 2018. Abstract 589. Presented on Dec. 3, 2018.
Smith et al., "Development and evaluation of human anti-BCMA CAR T cell therapy from concept to clinic: Outline," Presented at 2017 ASH annual meeting. Presentation [23 pages].
Smith et al., "Development and Evaluation of a Human Single Chain Variable Fragment (scFv) Derived BCMA Targeted CAR T Cell Vector Leads to a High Objective Response Rate in Patients with Advanced MM," Blood (2017) 130:742.
Sonneveld et al., "Treatment of multiple myeloma with high-risk cytogenetics: a consensus of the International Myeloma Working Group," Blood (2016) 127(24):2955-2962.
Sorensen et al., "Performance status assessment in cancer patients. An inter-observer variability study," Br J Cancer (1993) 67(4):773-775.
Stachel et al., "Enhanced lymphocyte proliferation responses in pediatric patients early after myelosuppressive chemotherapy," Pediatr Blood Cancer (2004) 43(6):644-650.
Szoka et al., "Comparative properties and methods of preparation of lipid vesicles (liposomes)," Ann. Rev. Biophys. Bioeng. (1980) 9: 467.
Tai et al., "Antibody-Based Therapies in Multiple Myeloma," Bone Marrow Research (2011) Article ID: 924058.
Tai et al., "Novel anti-B-cell maturation antigen antibody-drug conjugate (GSK2857916) selectively induces killing of multiple myeloma," Blood (2014) 123(20):3128-3138.
Tai et al., "Targeting B-cell maturation antigen in multiple myeloma," Immunotherapy (2015) 7(11):1187-1199.
Terakura et al., "Generation of CD19-chimeric antigen receptor modified CD8+ T cells derived from virus-specific central memory T cells," Blood (2012) 1:72-82.
Themeli et al., "Generation of tumor-targeted human T lymphocytes from induced pluripotent stem cells for cancer therapy," Nat Biotechnol. (2013) 31(10): 928-933.
Timmerman et al., "Functional reconstruction and synthetic mimicry of a conformational epitope using CLIPS technology," J Mol Recognit (2007) 20(5):283-299.
Topalian et al., "Safety, Activity, and Immune Correlates of Anti-PD-1 Antibody in Cancer," N Engl J Med (2012) 366:2443-2454.
Tsukahara et al., "CD19 target-engineered T-cells accumulate at tumor lesions in human B-cell lymphoma xenograft mouse models," Biochem Biophys Res Commun (2013) 438(1): 84-9.
Turk et al., "Concomitant tumor immunity to a poorly immunogenic melanoma is prevented by regulatory T cells," J Exp Med (2004) 200(6):771-782.
Turtle et al., "Engineered T cells for anti-cancer therapy," Curr. Opin. Immunol. (2012) 24(5): 633-39.
Van Tendeloo et al., "High-level transgene expression in primary human T lymphocytes and adult bone marrow CD34+ cells via electroporation-mediated gene delivery," Gene Therapy (2000) 7(16): 1431-1437).
Verhoeyen et al., "Lentiviral vector gene transfer into human T cells," Methods Mol Biol. (2009) 506: 97-114.
Wada et al., "Sequencing CTLA-4 blockade with cell-based immunotherapy for prostate cancer," J Transl Med (2013) 11:89.
Wadhwa et al., "Receptor mediated glycotargeting," J. Drug Targeting (1995) 3: 111.
Wang et al., "Phenotypic and functional attributes of lentivirus-modified CD19-specific human CD8+ central memory T cells manufactured at clinical scale," J Immunother. (2012) 35(9):689-701.
Weber, "Review: anti-CTLA-4 antibody ipilimumab: case studies of clinical response and immune-related adverse events," Oncologist (2007) 12(7):864-872.
Wigler et al., "Transfer of purified herpes virus thymidine kinase gene to cultured mouse cells," Cell (1997) 11: 223-232.
Wilson, "Tech.Sight. Analyzing biomolecular interactions," Science (2002) 295(5562):2103-2105.
Wolff et al., "Monoclonal Antibody Homodimers: Enhanced Antitumor Activity in Nude Mice," Can Res (1993) 53:2560-2565.
Works et al., "Lenalidomide Enhances Anti-BCMA Chimeric Antigen Receptor T Cell Function Against Multiple Myeloma," Blood (2017) 130:1794.
Wu et al., "Adoptive T-cell therapy using autologous tumor-infiltrating lymphocytes for metastatic melanoma: current status and future outlook," Cancer (2012) 18(2): 160-75.
Zhang et al., "CD73: a novel target for cancer immunotherapy," Cancer Res (2010) 70(16):6407-6411.
Zheng et al., "A novel anti-CEACAM5 monoclonal antibody, CC4, suppresses colorectal tumor growth and enhances NK cells-mediated tumor immunity," PLoS One (2011) 6(6):e21146.
Zheng et al., "Protein L: a novel reagent for the detection of chimeric antigen receptor (CAR) expression by flow cytometry," J Transl Med (2012) 10:29.
Clinical Trial Identifier NCT03502577, "BCMA-Specific CAR T-Cells Combined With a Gamma Secretase Inhibitor (JSMD194) to Treat Relapsed or Persistent Multiple Myeloma," Retrieved on https://clinicaltrials.gov/ct2/show/NCT03502577. Retrieved on Apr. 16, 2019.
Deniger et al., "A pilor trial of the combination of vemurafenib with adoptive cell therapy in patients with metastatic melanoma," Clin Can Res (2017) 23(2):351-362.
Fraiette et al., "Ibrutinib enhances chimeric antigen receptor T-cell engraftment and efficacy in leukemia," Blood (2016) 127:1117-1127.
Hill et al., "Gamma secretase inhibition increase recognition of multiple myeloma by BCMA-specific chimeric antigen receptor modified T cells," J Immunotherapy of Cancer (2017) 5(S2):010.
Khalil et al., "The future of cancer treatment: immunomodulation, CARs and combination immunotherapy," Nature Reviews Clinical Oncology (2016) 13(5):272-290.
Laurent et. al. "Gamma-secretase directly sheds the survival receptor BCMA from plamsa cells." Nat Communications (2015).
Long et al., "4-1BB costimulation ameliorates T cell exhaustion induced by tonic signaling of chimeric antigen receptors," Nat Med.(2012))21(6):581-590.
Ryan et al., "Antibody targeting of B-cell maturation antigen on malignant plasma cells," Molecular Cancer Therapeutics, American Association for Cancer Research (2007) 6911):3009-3018.
Smith et al., "Development and Evaluation of an Optimal Human Single-Chain Variable Fragment-Derived BCMA-Targeted CAR T Cell Vector," Mol Ther. (2018) 26:1447-1456.

(56) References Cited

OTHER PUBLICATIONS

Ullenhag et al., "Clinical and immune effects of lenalidomide in combination with gemcitabine in patients with advanced pancreatic cancer," PLOS One (2017) 12(1):e0169736.

Wang et al., "Lenalidomide enhances the function of CS1 chimeric antigen receptor redirected-T cells against multiple myeloma," Blood (2016) 128-812.

Worcester, "GSI inhibition may boost BCMA CAR T-cell therapy efficacy in myeloma," Hematology News. Published on Nov. 27, 2017. Retrieved on https://www.mdedge.com/hematology-oncology/article/152733/multiple-myeloma/gsi-inhibition-may-boost-bcma-car-t-cell-therapy.

Zheng et al., "Enhancing adoptive cell therapy of cancer through targete delivery of small-molecule immunomodulators to internalizing or noninternalizing receptors," ACS NANO (2017) 11(3):3089-3100.

* cited by examiner

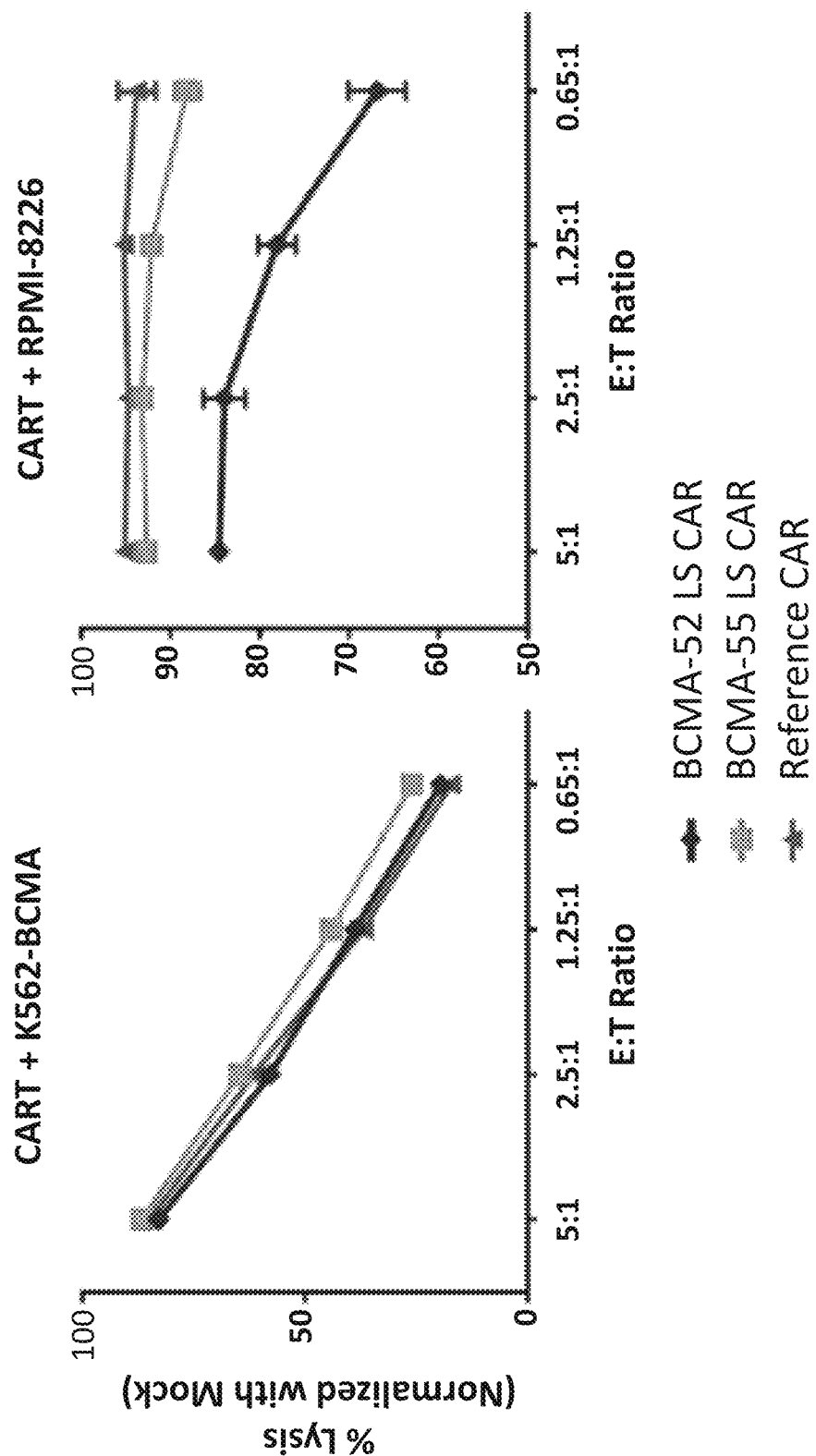

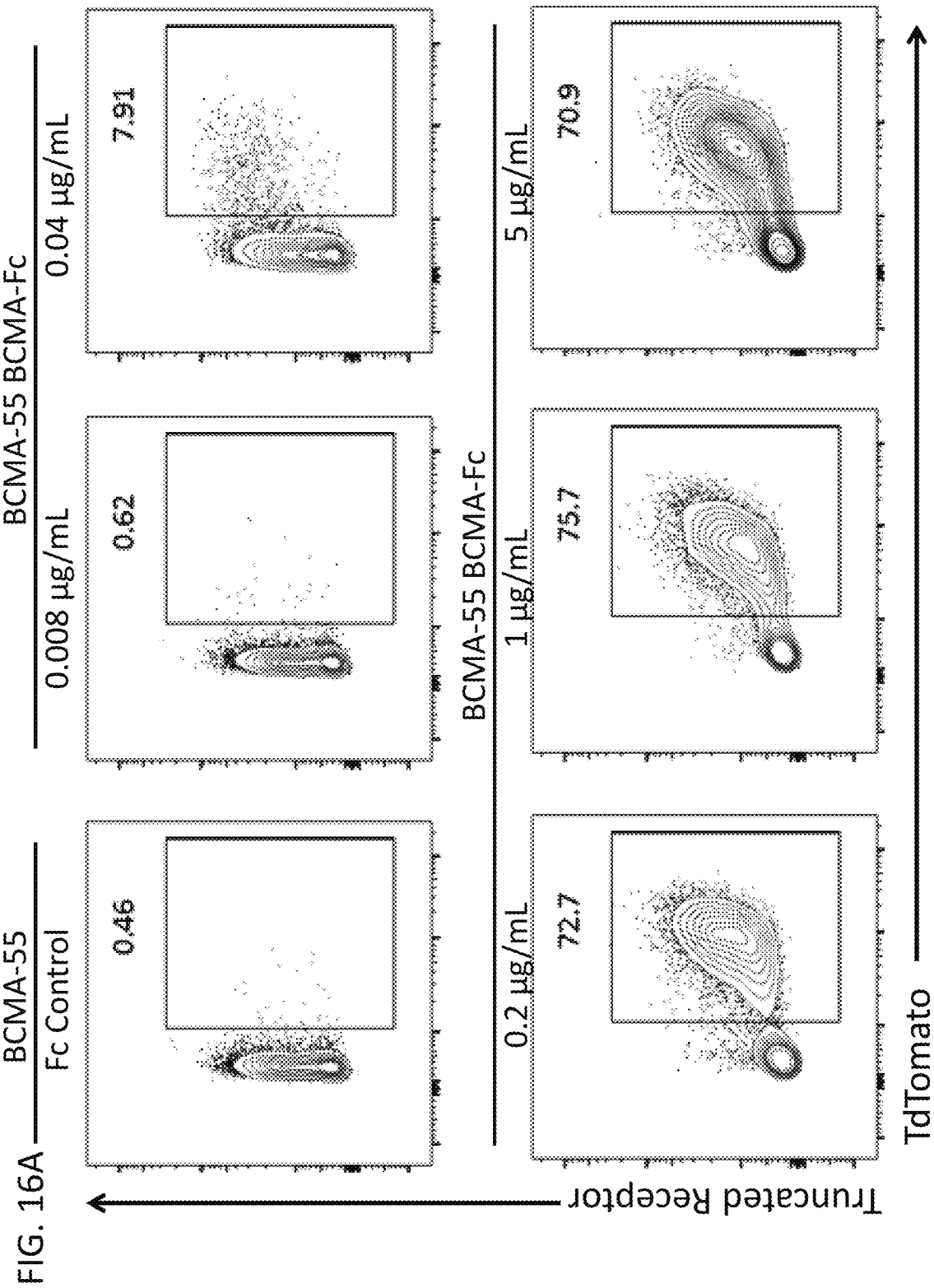

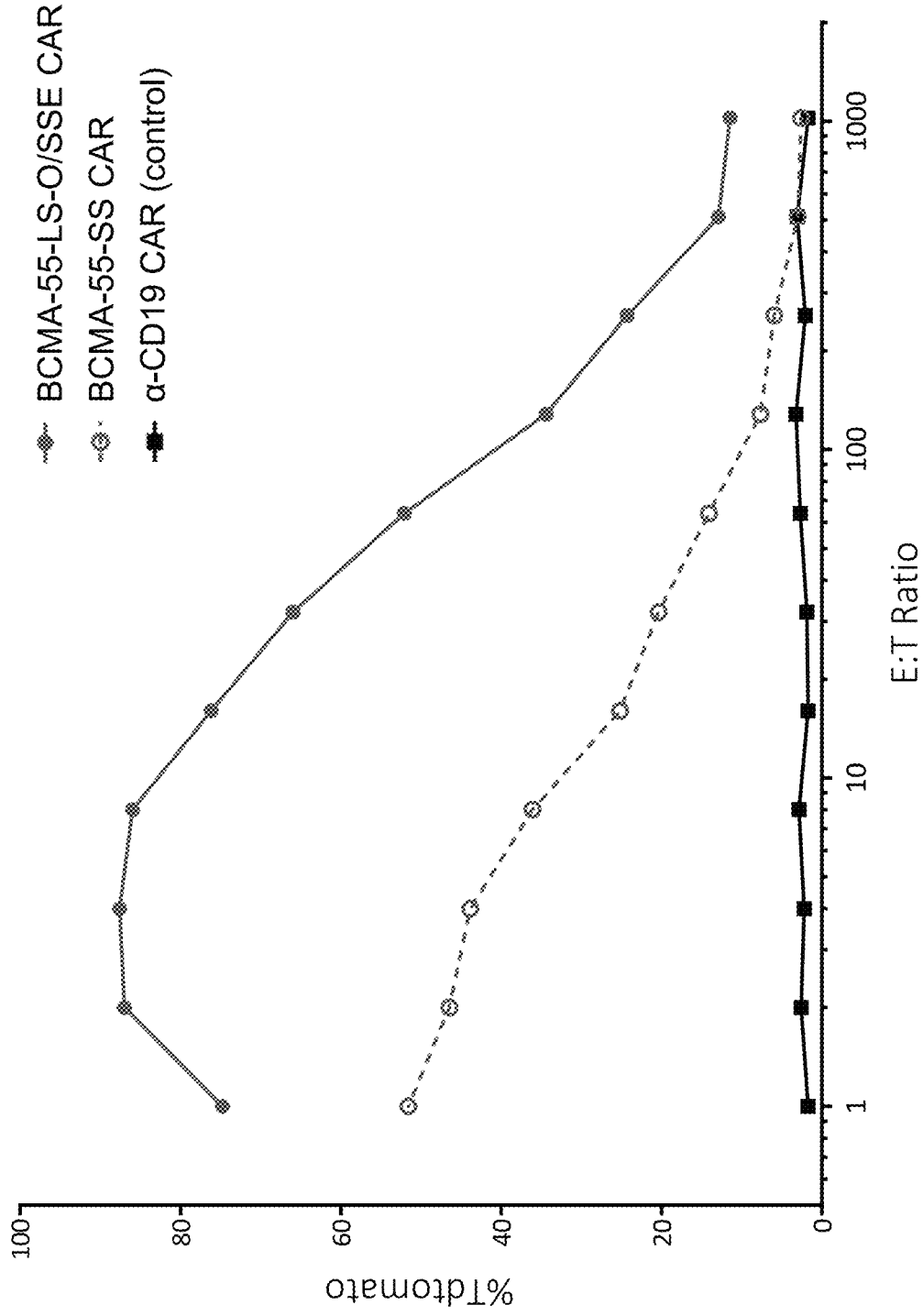

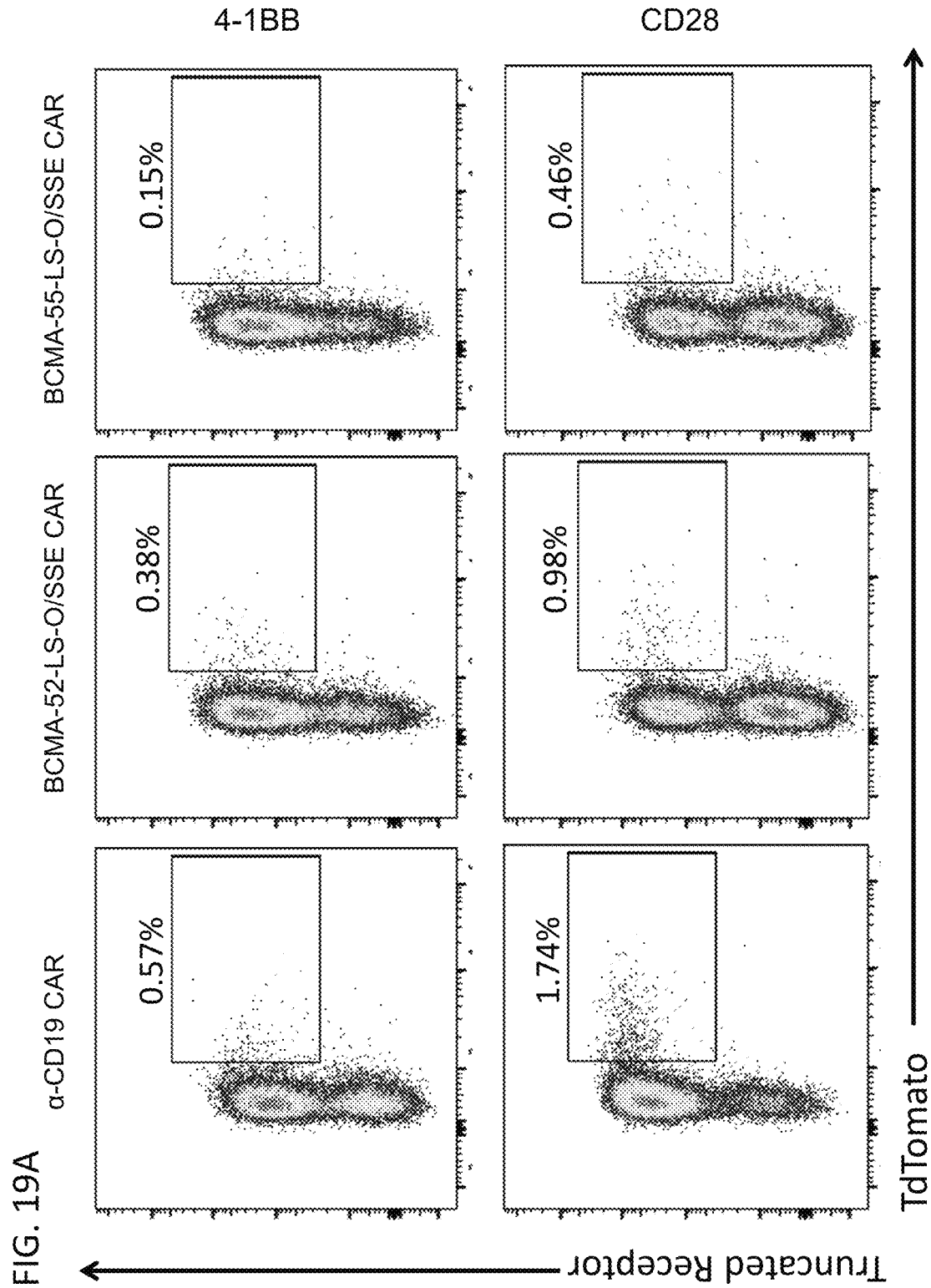

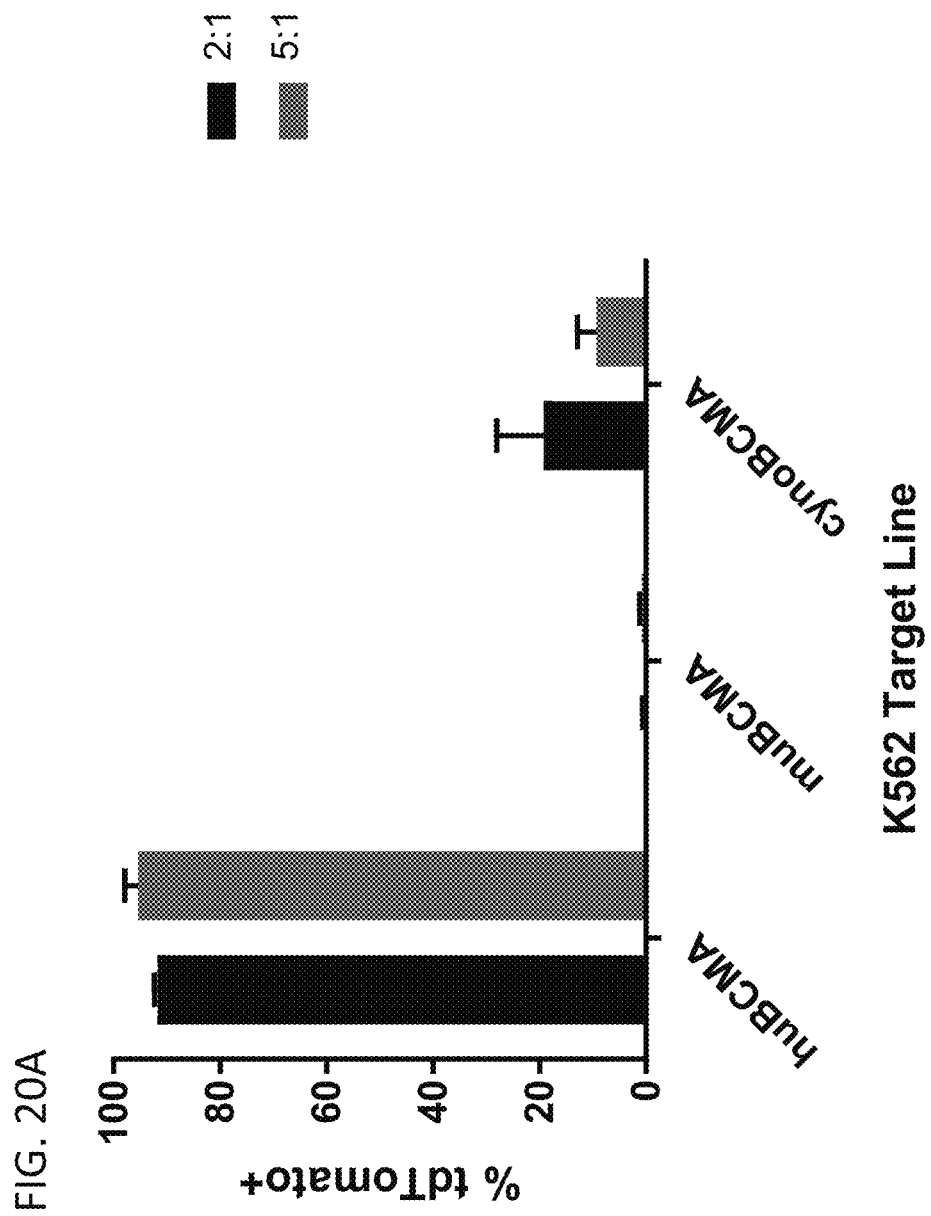

Amplified products a) no splice events b) Expected intrapromoter splice event c) Expected intrapromoter and unexpected (cryptic) intratransgene splice event d) Unexpected (cryptic) interdomain splice event

CHIMERIC ANTIGEN RECEPTORS SPECIFIC FOR B-CELL MATURATION ANTIGEN AND ENCODING POLYNUCLEOTIDES

CROSS-REFERENCE TO RELATED APPLICATIONS

This application claims priority from U.S. provisional application 62/580,439, filed Nov. 1, 2017, entitled "CHIMERIC ANTIGEN RECEPTORS SPECIFIC FOR B-CELL MATURATION ANTIGEN AND ENCODING POLYNUCLEOTIDES," U.S. provisional application No. 62/580,445, filed Nov. 1, 2017, entitled "CHIMERIC ANTIGEN RECEPTORS SPECIFIC FOR B-CELL MATURATION ANTIGEN AND ENCODING POLYNUCLEOTIDES," U.S. provisional application No. 62/582,932, filed Nov. 7, 2017, entitled "CHIMERIC ANTIGEN RECEPTORS SPECIFIC FOR B-CELL MATURATION ANTIGEN AND ENCODING POLYNUCLEOTIDES," U.S. provisional application No. 62/582,938, filed Nov. 7, 2017, entitled "CHIMERIC ANTIGEN RECEPTORS SPECIFIC FOR B-CELL MATURATION ANTIGEN AND ENCODING POLYNUCLEOTIDES," U.S. provisional application No. 62/596,765, filed Dec. 8, 2017, entitled "CHIMERIC ANTIGEN RECEPTORS SPECIFIC FOR B-CELL MATURATION ANTIGEN AND ENCODING POLYNUCLEOTIDES," U.S. provisional application No. 62/596,763, filed Dec. 8, 2017, entitled "CHIMERIC ANTIGEN RECEPTORS SPECIFIC FOR B-CELL MATURATION ANTIGEN AND ENCODING POLYNUCLEOTIDES," U.S. provisional application No. 62/614,960, filed Jan. 8, 2018, entitled "CHIMERIC ANTIGEN RECEPTORS SPECIFIC FOR B-CELL MATURATION ANTIGEN AND ENCODING POLYNUCLEOTIDES," U.S. provisional application No. 62/614,963, filed Jan. 8, 2018, entitled "CHIMERIC ANTIGEN RECEPTORS SPECIFIC FOR B-CELL MATURATION ANTIGEN AND ENCODING POLYNUCLEOTIDES," U.S. provisional application No. 62/665,442, filed May 1, 2018, entitled "CHIMERIC ANTIGEN RECEPTORS SPECIFIC FOR B-CELL MATURATION ANTIGEN AND ENCODING POLYNUCLEOTIDES," and U.S. provisional application No. 62/665,447, filed May 1, 2018, entitled "METHOD OF ASSESSING ACTIVITY OF RECOMBINANT ANTIGEN RECEPTORS," the contents of which are incorporated by reference in their entirety.

INCORPORATION BY REFERENCE OF SEQUENCE LISTING

The present application is being filed along with a Sequence Listing in electronic format. The Sequence Listing is provided as a file entitled 735042009900SeqList.txt, created Nov. 1, 2018, which is 593 kilobytes in size. The information in the electronic format of the Sequence Listing is incorporated by reference in its entirety.

FIELD

The present disclosure relates in some aspects to chimeric antigen receptors (CARs), which contain antibody portions specific to B-cell maturation antigen (BCMA) and polynucleotides that encode CARs specific for BCMA. The disclosure further relates to genetically engineered cells, containing such BCMA-binding receptors, and uses thereof in adoptive cell therapy.

BACKGROUND

B-cell maturation antigen (BCMA) is a transmembrane type III protein expressed on mature B lymphocytes. Following binding of BCMA to its ligands, B cell activator of the TNF family (BAFF) or a proliferation inducing ligand (APRIL), a pro-survival cell signal is delivered to the B cell which has been found to be required for plasma cell survival. The expression of BCMA has been linked to several diseases including cancer, autoimmune disorders and infectious diseases Due to the role of BCMA in various diseases and conditions, including cancer, BCMA is a therapeutic target. Various BCMA-binding chimeric antigen receptors (CARs), and cells expressing such CARs, are available. However, there remains a need for improved BCMA-binding CARs and engineered BCMA-CAR expressing targeting cells, such as for use in adoptive cell therapy. Provided herein are embodiments that meet such needs.

SUMMARY

Provided are polynucleotides encoding a chimeric antigen receptor, containing nucleic acid encoding: (a) an extracellular antigen-binding domain that specifically recognizes an antigen; (b) a spacer of at least 125 amino acids in length; (c) a transmembrane domain; and (d) an intracellular signaling region, wherein following expression of the polynucleotide in a cell, the transcribed RNA, optionally messenger RNA (mRNA), from the polynucleotide, exhibits at least 70%, 75%, 80%, 85%, 90%, or 95% RNA homogeneity. In some cases, the spacer is derived from an immunoglobulin. In some embodiments, the spacer includes a sequence of a hinge region, a $C_H2$ and a $C_H3$ region. In some embodiments, one of more of the hinge, $C_H2$ and $C_H3$ is derived all or in part from IgG4 or IgG2. In some cases, the hinge, $C_H2$ and $C_H3$ is derived from IgG4. In some aspects, one or more of the hinge, $C_H2$ and $C_H3$ is chimeric and contains sequence derived from IgG4 and IgG2. In some examples, the spacer contains an IgG4/2 chimeric hinge, an IgG2/4 $C_H2$, and an IgG4 $C_H3$ region. In some embodiments, the encoded spacer is or contains (i) the sequence set forth in SEQ ID NO: 649; (ii) a functional variant of SEQ ID NO:649 that has at least 95%, 96%, 97%, 98% or 99% sequence identity to SEQ ID NO:649; or (iii) a contiguous portion of (i) or (ii) that is at least 125 amino acids in length. In some embodiments, the encoded spacer is or includes the sequence set forth in SEQ ID NO: 649.

In some of any embodiments, the spacer has a length of 125 to 300 amino acids in length, 125 to 250 amino acids in length, 125 to 230 amino acids in length, 125 to 200 amino acids in length, 125 to 180 amino acids in length, 125 to 150 amino acids in length, 150 to 300 amino acids in length, 150 to 250 amino acids in length, 150 to 230 amino acids in length, 150 to 200 amino acids in length, 150 to 180 amino acids in length, 180 to 300 amino acids in length, 180 to 250 amino acids in length, 180 to 230 amino acids in length, 180 to 200 amino acids in length, 200 to 300 amino acids in length, 200 to 250 amino acids in length, 200 to 230 amino acids in length, 230 to 300 amino acids in length, 230 to 250 amino acids in length or 250 to 300 amino acids in length. In some embodiments, the spacer is at least or at least about or is or is about 130, 140, 150, 160, 170, 180, 190, 200, 210, 220, 221, 222, 223, 224, 225, 226, 227, 228 or 229 amino acids in length, or a length between any of the foregoing.

In some embodiments of any of the polynucleotides described herein, the nucleic acid encoding the spacer includes at least one modified splice donor and/or splice acceptor site, said modified splice donor and/or acceptor site containing one or more nucleotide modifications corresponding to a reference splice donor site and/or reference splice acceptor site contained in the sequence set forth in SEQ ID NO:621. In some cases, the one or more nucleotide modifications contains an insertion, deletion, substitution or combinations thereof. In some instances, the reference splice acceptor and/or reference splice donor sites are canonical, non-canonical, or cryptic splice sites. In some examples, the reference splice donor and/or reference splice acceptor site(s) has a splice site prediction score of at least or about 0.4, 0.5, 0.6, 0.70, 0.75, 0.80, 0.85, 0.90, 0.95, 0.99, or 1.0; and/or the reference splice donor and/or reference splice acceptor site(s) is/are predicted to be involved in a splice event with a probability of at least 40%, 50%, 60%, 70%, 75%, 80%, 85%, 90%, 95%, 99%, or 100%.

In some embodiments of any of the polynucleotides described herein, the reference splice donor site includes the sequence aatctaagtacggac (SEQ ID NO: 705), tcaactggtacgtgg (SEQ ID NO:706), acaattagtaaggca (SEQ ID NO:707) and/or accacaggtgtatac (SEQ ID NO:708); and/or the reference splice acceptor site includes the sequence aagtttctttctgtattccaggctgaccgtggataaatctc (SEQ ID NO:742) and/or gggcaacgtgttctcttgcagtgtcatgcacgaagccctgc (SEQ ID NO:743). In some embodiments, the reference splice donor and/or reference splice acceptor site(s) has a splice site prediction score of at least or about 0.70, 0.75, 0.80, 0.85, 0.90, 0.95, 0.99, or 1.0; and/or the reference splice donor and/or reference splice acceptor site(s) is/are predicted to be involved in a splice event with a probability of at least 70%, 75%, 80%, 85%, 90%, 95%, 99%, or 100%. In some embodiments, the reference splice donor site contains the sequence tcaactggtacgtgg (SEQ ID NO:706); and/or the reference splice acceptor site contains the sequence (SEQ ID NO: 742)
aagtttctttctgtattccaggctgaccgtggataaatctc.

In some embodiments of any of the polynucleotides described herein, at least one of the one or more nucleotide modifications are within 1, 2, 3, 4, 5, 6, 7, 8, 9 or 10 residues of the splice site junction of the reference splice acceptor and/or reference splice donor site. In some aspects, the one or more nucleotide modifications is silent and/or results in a degenerate codon compared to SEQ ID NO:621 and/or does not change the amino acid sequence of the encoded spacer. In some embodiments, the modified splice donor site is set forth in agtctaaatacggac (SEQ ID NO:661), tcaactggtatgtgg (SEQ ID NO:662), accatctccaaggcc (SEQ ID NO:663) and/or gccccaggtttacac (SEQ ID NO:664); and/or the modified splice acceptor site is set forth in cagtttcttcctgtatagtagact-caccgtggataaatcaa (SEQ ID NO:672) gggcaacgtgttcagctgcagcgtgatgcacgaggccctgc (SEQ ID NO: 673) and/or aagtttctttctgtattccagactgaccgtggataaatctc (SEQ ID NO:854). In some cases, the modified splice donor site is set forth in tcaactggtatgtgg (SEQ ID NO:662) and/or the modified acceptor site is set forth in cagtttcttcctgtatagtagact-caccgtggataaatcaa (SEQ ID NO:672). In some of any such embodiments, the spacer is encoded by a sequence of nucleotide set forth in SEQ ID NO:622 or a portion thereof.

Provided is a polynucleotide encoding a chimeric antigen receptor, wherein the polynucleotide includes nucleic acid encoding: (a) an extracellular antigen-binding domain that specifically recognizes an antigen; (b) a spacer, wherein the encoding nucleic acid is or includes the sequence set forth in SEQ ID NO:622 or encodes a sequence of amino acids set forth in SEQ ID NO:649; (c) a transmembrane domain; and (d) an intracellular signaling region.

Also provided is a polynucleotide encoding a chimeric antigen receptor, wherein the polynucleotide including nucleic acid encoding: (a) an extracellular antigen-binding domain that specifically recognizes an antigen; (b) a spacer, wherein the encoding nucleic acid includes or mostly includes the sequence set forth in SEQ ID NO:622 or encodes a sequence of amino acids set forth in SEQ ID NO:649; (c) a transmembrane domain; and (d) an intracellular signaling region.

In some of any of the embodiments, following expression of the polynucleotide in a cell, the transcribed RNA, optionally messenger RNA (mRNA), from the polynucleotide, exhibits at least 70%, 75%, 80%, 85%, 90%, or 95% RNA homogeneity. In some embodiments, following expression in a cell, the transcribed RNA, optionally messenger RNA (mRNA), from the polynucleotide exhibits reduced heterogeneity compared to the heterogeneity of the mRNA transcribed from a reference polynucleotide, said reference polynucleotide encoding the same amino acid sequence as the polynucleotide, wherein the reference polynucleotide differs by the presence of one or more splice donor site and/or one or more splice acceptor site in the nucleic acid encoding the spacer and/or includes one or more nucleotide modifications compared to the polynucleotide. In some instances, the RNA heterogeneity is reduced by greater than or greater than about 10%, 15%, 20%, 25%, 30%, 40%, 50% or more. In some cases, the transcribed RNA, optionally messenger RNA (mRNA), from the reference polynucleotide exhibits greater than or greater than about 10%, 15%, 20%, 25%, 30%, 40%, 50% or more RNA heterogeneity. In some of any such embodiments, the RNA homogeneity and/or heterogeneity is determined by agarose gel electrophoresis, chip-based capillary electrophoresis, analytical ultracentrifugation, field flow fractionation, or liquid chromatography. In some of any such embodiments, the polynucleotide is codon-optimized.

In some embodiments of any of the polynucleotides described herein, the antigen is associated with the disease or condition or expressed in cells of the environment of a lesion associated with the disease or condition. In some cases, the disease or condition is a cancer. In some examples, the disease or condition is a myeloma, leukemia or lymphoma. In some embodiments, the antigen is ROR1, B cell maturation antigen (BCMA), carbonic anhydrase 9 (CAIX), tEGFR, Her2/neu (receptor tyrosine kinase erbB2), L1-CAM, CD19, CD20, CD22, mesothelin, CEA, and hepatitis B surface antigen, anti-folate receptor, CD23, CD24, CD30, CD33, CD38, CD44, EGFR, epithelial glycoprotein 2 (EPG-2), epithelial glycoprotein 40 (EPG-40), EPHa2, erb-B2, erb-B3, erb-B4, erbB dimers, EGFR vIII, folate binding protein (FBP), FCRL5, FCRH5, fetal acetylcholine receptor, GD2, GD3, HMW-MAA, IL-22R-alpha, IL-13R-alpha2, kinase insert domain receptor (kdr), kappa light chain, Lewis Y, L1-cell adhesion molecule, (L1-CAM), Melanoma-associated antigen (MAGE)-A1, MAGE-A3, MAGE-A6, Preferentially expressed antigen of melanoma (PRAME), survivin, TAG72, B7-H6, IL-13 receptor alpha 2 (IL-13Ra2), CA9, GD3, HMW-MAA, CD171, G250/CAIX, HLA-AI MAGE A1, HLA-A2 NY-ESO-1, PSCA, folate receptor-a, CD44v6, CD44v7/8, avb6 integrin, 8H9, NCAM, VEGF receptors, 5T4, Foetal AchR, NKG2D ligands, CD44v6, dual antigen, a cancer-testes antigen, mesothelin, murine CMV, mucin 1 (MUC1), MUC16, PSCA, NKG2D, NY-ESO-1, MART-1, gp100, oncofetal antigen, ROR1, TAG72, VEGF-R2, carcinoembryonic antigen (CEA), Her2/neu, estrogen receptor, progesterone receptor, ephrinB2, CD123, c-Met, GD-2, O-acetylated GD2 (OGD2), CE7, Wilms Tumor 1 (WT-1), a cyclin, cyclin A2, CCL-1, CD138, a pathogen-specific antigen. In some cases, the antigen is B cell maturation antigen (BCMA).

In some of any such embodiments, the antigen-binding domain is an antibody fragment containing a variable heavy chain ($V_H$) and a variable light chain ($V_L$) region. In some aspects, the $V_H$ region is or includes an amino acid sequence having at least 90%, 91%, 92%, 93%, 94%, 95%, 96%, 97%, 98% or 99% sequence identity to the $V_H$ region amino acid sequence set forth in any of SEQ ID NOs:110-115, 247-256, 324, 325, 518-531, 533, 609 617, 772-774, or 814-832; and/or the $V_L$ region is or includes an amino acid sequence having at least 90%, 91%, 92%, 93%, 94%, 95%, 96%, 97%, 98%, or 99% sequence identity to the $V_L$ region amino acid sequence set forth in any of SEQ ID NOs:116-127, 257-267, 326, 327, 534-550, 552-557, 610, 618, 775-777, or 833-849. In some cases, the $V_H$ region is or includes an amino acid sequence having at least 90%, 91%, 92%, 93%, 94%, 95%, 96%, 97%, 98% or 99% sequence identity to the $V_H$ region amino acid sequence set forth in any of SEQ ID NOs: 110, 111, 112, 113, 115, 248, 252, 253, 254, 255, 256, 324, 325, 518, 519, 520, 521, 522, 609, 617, 772-774, or 814-832; and/or the $V_L$ region is or includes an amino acid sequence having at least 90%, 91%, 92%, 93%, 94%, 95%, 96%, 97%, 98%, or 99% sequence identity to the $V_L$ region amino acid sequence set forth in any of SEQ ID NOs: 116, 117, 118, 120, 121, 124, 125, 258, 262, 263, 264, 265, 266, 267, 326, 327, 534, 535, 536, 537, 538, 610, 618, 775-777, or 833-849.

In some embodiments of any of the polynucleotides described herein, the $V_H$ region is or contains a CDR-H1, CDR-H2 and CDR-H3 contained within the $V_H$ region amino acid sequence selected from any one of SEQ ID NOs:110-115, 247-256, 324, 325, 518-531, 533, 609, 617, 772-774, or 814-832; and/or the $V_L$ region is or includes a CDR-L1, CDR-L2 and CDR-L3 contained within the $V_L$ region amino acid sequence selected from any one of SEQ ID NOs:116-127, 257-267, 326, 327, 534-550, 552-557, 610, 618, 775-777, or 833-849. In some embodiments, the $V_H$ region is or contains a CDR-H1, CDR-H2 and CDR-H3 contained within the $V_H$ region amino acid sequence selected from any one of SEQ ID NOs: 110, 111, 112, 113, 115, 248, 252, 253, 254, 255, 256, 324, 325, 518, 519, 520, 521, 522, 609, 617, 772-774, or 814-832; and/or the $V_L$ region is or includes a CDR-L1, CDR-L2 and CDR-L3 contained within the $V_L$ region amino acid sequence selected from any one of SEQ ID NOs: 116, 117, 118, 120, 121, 124, 125, 258, 262, 263, 264, 265, 266, 267, 326, 327, 534, 535, 536, 537, 538, 610, 618, 775-777, or 833-849. In some embodiments, the $V_H$ region is or includes (a) a heavy chain complementarity determining region 1 (CDR-H1) containing the amino acid sequence selected from any one of SEQ ID NOs:1-3, 140-144, 288, 289, 294, 295, 507, 532, 593, 596, 604, 611; and/or (b) a heavy chain complementarity determining region 2 (CDR-H2) containing the amino acid sequence selected from any one of SEQ ID NOs:4-6, 145-148, 290, 291, 296, 297, 372-374, 513, 551, 594, 597, 605, or 612; and (c) a heavy chain complementarity determining region 3 (CDR-H3) containing the amino acid sequence selected from any one of SEQ ID NOs:7-11, 149-157, 279-287, 292, 293, 376-378, 517, 595, 606, 613; and/or the $V_L$ region is or includes (a) a light chain complementarity determining region 1 (CDR-L1) containing the amino acid sequence selected from any one of SEQ ID NOs:26-36, 174-178, 302, 303, 380-392, 394-398, 589, 601, 607 or 614; (b) a light chain complementarity determining region 2 (CDR-L2) containing the amino acid sequence selected from any one of SEQ ID NOs:37-46, 179-183, 304, 305, 399-409, 411-414, 590, 602, 608 or 615; and (c) a light chain complementarity determining region 3 (CDR-L3) containing the amino acid sequence selected from any one of SEQ ID NOs:47-58, 184-194, 306, 307, 415-427, 429-433, 591, or 603.

In some embodiments of any of the polynucleotides described herein, the $V_H$ region is or contains (a) a heavy chain complementarity determining region 1 (CDR-H1) containing the amino acid sequence selected from any one of SEQ ID NOs: 1, 2, 3, 141, 143, 144, 288, 289, 507, 593, 604, 611; and/or (b) a heavy chain complementarity determining region 2 (CDR-H2) containing the amino acid sequence selected from any one of SEQ ID NOs: 4, 5, 6, 145, 147, 148, 290, 291, 372, 513, 594, 605 or 612; and (c) a heavy chain complementarity determining region 3 (CDR-H3) containing the amino acid sequence selected from any one of SEQ ID NOs: 7, 8, 9, 10, 149, 153, 154, 155, 156, 157, 292, 293, 376, 517, 595, 606 or 613; and/or the $V_L$ region is or contains (a) a light chain complementarity determining region 1 (CDR-L1) containing the amino acid sequence selected from any one of SEQ ID NOs: 26, 27, 28, 30, 31, 33, 34, 174, 176, 177, 178, 302, 303, 380, 381, 382, 589, 601, 607 or 614; (b) a light chain complementarity determining region 2 (CDR-L2) containing the amino acid sequence selected from any one of SEQ ID NOs: 37, 38, 39, 41, 43, 44, 179, 181, 182, 183, 304, 305, 399, 400, 401, 402, 590, 602, 608 or 615; and (c) a light chain complementarity determining region 3 (CDR-L3) containing the amino acid sequence selected from any one of SEQ ID NOs: 47, 48, 49, 51, 52, 55, 56, 185, 189, 190, 191, 192, 193, 194, 306, 307, 415, 417, 418, 421, 591, or 603.

In some embodiments of any of the polynucleotides described herein, the $V_H$ region contains a CDR-H1, CDR-H2, and CDR-H3, selected from: a CDR-H1, CDR-H2, and CDR-H3 containing the amino acid sequence of SEQ ID NOs:1, 4, and 7, respectively; a CDR-H1, CDR-H2, and CDR-H3 containing the amino acid sequence of SEQ ID NOs:2, 5, and 8, respectively; a CDR-H1, CDR-H2, and CDR-H3 containing the amino acid sequence of SEQ ID NOs:2, 5, and 9, respectively; a CDR-H1, CDR-H2, and CDR-H3 containing the amino acid sequence of SEQ ID NOs:2, 5, and 10, respectively; a CDR-H1, CDR-H2, and CDR-H3 containing the amino acid sequence of SEQ ID NOs:3, 6, and 11, respectively; a CDR-H1, CDR-H2, and CDR-H3 containing the amino acid sequence of SEQ ID NOs:140, 145, and 149, respectively; a CDR-H1, CDR-H2, and CDR-H3 containing the amino acid sequence of SEQ ID NOs:141, 145, and 149, respectively; a CDR-H1, CDR-H2, and CDR-H3 containing the amino acid sequence of SEQ ID NOs:141, 145, and 150, respectively; a CDR-H1, CDR-H2, and CDR-H3 containing the amino acid sequence of SEQ ID NOs:142, 146, and 151, respectively; a CDR-H1, CDR-H2, and CDR-H3 containing the amino acid sequence of SEQ ID NOs:2, 5, and 152, respectively; a CDR-H1, CDR-H2, and CDR-H3 containing the amino acid sequence of SEQ ID NOs:143, 147, and 153, respectively; a CDR-H1, CDR-H2, and CDR-H3 containing the amino acid sequence of SEQ ID NOs:144, 148, and 154, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:2, 5, and 156, respectively; a CDR-H1, CDR-H2, and CDR-H3 containing the amino acid sequence of SEQ ID NOs:2, 5, and 157, respectively; a CDR-H1, CDR-H2, and CDR-H3 containing the amino acid sequence of SEQ ID NOs:2, 6, and 376, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:3, 372, and 376, respectively; a CDR-H1, CDR-H2, and CDR-H3 containing the amino acid sequence of SEQ ID NOs:3, 6, and 376, respectively; a CDR-H1, CDR-H2, and CDR-H3 containing the amino acid sequence of SEQ ID NOs:3, 6, and 377, respectively; a CDR-H1, CDR-H2, and CDR-H3 containing the amino acid sequence of SEQ ID NOs:2, 373, and 152, respectively; a CDR-H1, CDR-H2, and CDR-H3 containing the amino acid sequence of SEQ ID NOs:2, 5, and 378, respectively; a CDR-H1, CDR-H2, and CDR-H3 containing the amino acid sequence of SEQ ID NOs:2, 374, and 9, respectively; a CDR-H1, CDR-H2, and CDR-H3 containing the amino acid sequence of SEQ ID NOs:593, 594, and 595, respectively; a CDR-H1, CDR-H2, and CDR-H3 containing the amino acid sequence of SEQ ID NOs:611, 612, and 613, respectively; a CDR-H1, CDR-H2, and CDR-H3 containing the amino acid sequence of SEQ ID NOs:507, 513, and 517, respectively; a CDR-H1, CDR-H2, and CDR-H3 containing the amino acid sequence of SEQ ID NOs:604, 605, and 606, respectively; a CDR-H1, CDR-H2, and CDR-H3 containing the amino acid sequence of SEQ ID NOs:288, 290, and 292, respectively; or a CDR-H1, CDR-H2, and CDR-H3 containing the amino acid sequence of SEQ ID NOs:289, 291, and 293, respectively.

In some embodiments of any of the polynucleotides described herein, the $V_H$ region contains a CDR-H1, CDR-H2, and CDR-H3, selected from: a CDR-H1, CDR-H2, and CDR-H3 containing the amino acid sequence of SEQ ID NOs:1, 4, and 7, respectively; a CDR-H1, CDR-H2, and CDR-H3 containing the amino acid sequence of SEQ ID NOs:2, 5, and 8, respectively; a CDR-H1, CDR-H2, and CDR-H3 containing the amino acid sequence of SEQ ID NOs:2, 5, and 9, respectively; a CDR-H1, CDR-H2, and CDR-H3 containing the amino acid sequence of SEQ ID NOs:2, 5, and 10, respectively; a CDR-H1, CDR-H2, and CDR-H3 containing the amino acid sequence of SEQ ID NOs:141, 145, and 149, respectively; a CDR-H1, CDR-H2, and CDR-H3 containing the amino acid sequence of SEQ ID NOs:143, 147, and 153, respectively; a CDR-H1, CDR-H2, and CDR-H3 containing the amino acid sequence of SEQ ID NOs:144, 148, and 154, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:2, 5, and 156, respectively; a CDR-H1, CDR-H2, and CDR-H3 containing the amino acid sequence of SEQ ID NOs:2, 5, and 157, respectively; a CDR-H1, CDR-H2, and CDR-H3 containing the amino acid sequence of SEQ ID NOs:2, 6, and 376, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:3, 372, and 376, respectively; a CDR-H1, CDR-H2, and CDR-H3 containing the amino acid sequence of SEQ ID NOs:3, 6, and 376, respectively; a CDR-H1, CDR-H2, and CDR-H3 containing the amino acid sequence of SEQ ID NOs:593, 594, and 595, respectively; a CDR-H1, CDR-H2, and CDR-H3 containing the amino acid sequence of SEQ ID NOs:611, 612, and 613, respectively; a CDR-H1, CDR-H2, and CDR-H3 containing the amino acid sequence of SEQ ID NOs:507, 513, and 517, respectively; a CDR-H1, CDR-H2, and CDR-H3 containing the amino acid sequence of SEQ ID NOs:604, 605, and 606, respectively; a CDR-H1, CDR-H2, and CDR-H3 containing the amino acid sequence of SEQ ID NOs:288, 290, and 292, respectively; or a CDR-H1, CDR-H2, and CDR-H3 containing the amino acid sequence of SEQ ID NOs:289, 291, and 293, respectively;

In some embodiments of any of the polynucleotides described herein, the $V_H$ region is or includes the amino acid sequence set forth in any of SEQ ID NOs: 110-115, 247-256, 324, 325, 518-531, 533, 609, 617, 772-774, or 814-832. In some aspects, the $V_H$ region is or includes the amino acid sequence set forth in any of SEQ ID NOs: 110, 111, 112, 113, 115, 248, 252, 253, 254, 255, 256, 324, 325, 518, 519, 520, 521, 522, 609 or 617. In some embodiments, the $V_H$ region contains a CDR-H1, CDR-H2, and CDR-H3 containing the amino acid sequence of SEQ ID NOs:593, 594, and 595, respectively; or the $V_H$ region includes a CDR-H1, CDR-H2, and CDR-H3 containing the amino acid sequence of SEQ ID NOs:611, 612, and 613, respectively. In some embodiments, the $V_H$ region is or includes the amino acid sequence set forth in SEQ ID NO: 617.

In some embodiments of any of the polynucleotides described herein, the $V_L$ region includes a CDR-L1, CDR-L2, and CDR-L3 selected from: a CDR-L1, CDR-L2, and CDR-L3 containing the amino acid sequence of SEQ ID NOs:26, 37, and 47, respectively; a CDR-L1, CDR-L2, and CDR-L3 containing the amino acid sequence of SEQ ID NOs:27, 38, and 48, respectively; a CDR-L1, CDR-L2, and CDR-L3 containing the amino acid sequence of SEQ ID NOs:28, 39, and 49, respectively; a CDR-L1, CDR-L2, and CDR-L3 containing the amino acid sequence of SEQ ID NOs:29, 40, and 50, respectively; a CDR-L1, CDR-L2, and CDR-L3 containing the amino acid sequence of SEQ ID NOs:30, 39, and 51, respectively; a CDR-L1, CDR-L2, and CDR-L3 containing the amino acid sequence of SEQ ID NOs:31, 41, and 52, respectively; a CDR-L1, CDR-L2, and CDR-L3 containing the amino acid sequence of SEQ ID NOs:32, 42, and 53, respectively; a CDR-L1, CDR-L2, and CDR-L3 containing the amino acid sequence of SEQ ID NOs:30, 39, and 54, respectively; a CDR-L1, CDR-L2, and CDR-L3 containing the amino acid sequence of SEQ ID NOs:33, 43, and 55, respectively; a CDR-L1, CDR-L2, and CDR-L3 containing the amino acid sequence of SEQ ID NOs:34, 44, and 56, respectively; a CDR-L1, CDR-L2, and CDR-L3 containing the amino acid sequence of SEQ ID NOs:35, 45, and 57, respectively; a CDR-L1, CDR-L2, and CDR-L3 containing the amino acid sequence of SEQ ID NOs:36, 46, and 58, respectively; a CDR-L1, CDR-L2, and CDR-L3 containing the amino acid sequence of SEQ ID NOs:174, 179, and 184, respectively; a CDR-L1, CDR-L2, and CDR-L3 containing the amino acid sequence of SEQ ID NOs:174, 179, and 185, respectively; a CDR-L1, CDR-L2, and CDR-L3 containing the amino acid sequence of SEQ ID NOs:174, 179, and 186, respectively; a CDR-L1, CDR-L2, and CDR-L3 containing the amino acid sequence of SEQ ID NOs:174, 179, and 187, respectively; a CDR-L1, CDR-L2, and CDR-L3 containing the amino acid sequence of SEQ ID NOs:175, 180, and 188, respectively; a CDR-L1, CDR-L2, and CDR-L3 containing the amino acid sequence of SEQ ID NOs:174, 179, and 189, respectively; a CDR-L1, CDR-L2, and CDR-L3 containing the amino acid sequence of SEQ ID NOs:176, 181, and 190, respectively; a CDR-L1, CDR-L2, and CDR-L3 containing the amino acid sequence of SEQ ID NOs:177, 182, and 191, respectively; a CDR-L1, CDR-L2, and CDR-L3 containing the amino acid sequence of SEQ ID NOs:174, 179, and 192, respectively; a CDR-L1, CDR-L2, and CDR-L3 containing the amino acid sequence of SEQ ID NOs:178, 183, and 193, respectively; a CDR-L1, CDR-L2, and CDR-L3 containing the amino acid sequence of SEQ ID NOs:178, 183, and 194, respectively; a CDR-L1, CDR-L2, and CDR-L3 containing the amino acid sequence of SEQ ID NOs:30, 399, and 415, respectively; a CDR-L1, CDR-L2, and CDR-L3 containing the amino acid sequence of SEQ ID NOs:380, 400, and 416, respectively; a CDR-L1, CDR-L2, and CDR-L3 containing the amino acid sequence of SEQ ID NOs:33, 43, and 421, respectively; a CDR-L1, CDR-L2, and CDR-L3 containing the amino acid sequence of SEQ ID NOs:381, 401, and 417, respectively; a CDR-L1, CDR-L2, and CDR-L3 containing the amino acid sequence of SEQ ID NOs:382, 402, and 418, respectively; a CDR-L1, CDR-L2, and CDR-L3 containing the amino acid sequence of SEQ ID NOs:383, 403, and 419, respectively; a CDR-L1, CDR-L2, and CDR-L3 containing the amino acid sequence of SEQ ID NOs:384, 39, and 54, respectively; a CDR-L1, CDR-L2, and CDR-L3 containing the amino acid sequence of SEQ ID NOs:385, 180, and 58, respectively; a CDR-L1, CDR-L2, and CDR-L3 containing the amino acid sequence of SEQ ID NOs:175, 180, and 188, respectively; a CDR-L1, CDR-L2, and CDR-L3 containing the amino acid sequence of SEQ ID NOs:386, 404, and 420, respectively; a CDR-L1, CDR-L2, and CDR-L3 containing the amino acid sequence of SEQ ID NOs:387, 405, and 422, respectively; a CDR-L1, CDR-L2, and CDR-L3 containing the amino acid sequence of SEQ ID NOs:388, 406, and 423, respectively; a CDR-L1, CDR-L2, and CDR-L3 containing the amino acid sequence of SEQ ID NOs:388, 407, and 424, respectively; a CDR-L1, CDR-L2, and CDR-L3 containing the amino acid sequence of SEQ ID NOs:389, 408, and 425, respectively; a CDR-L1, CDR-L2, and CDR-L3 containing the amino acid sequence of SEQ ID NOs:390, 183, and 193, respectively; a CDR-L1, CDR-L2, and CDR-L3 containing the amino acid sequence of SEQ ID NOs:391, 409, and 426, respectively; a CDR-L1, CDR-L2, and CDR-L3 containing the amino acid sequence of SEQ ID NOs:392, 40, and 427, respectively; a CDR-L1, CDR-L2, and CDR-L3 containing the amino acid sequence of SEQ ID NOs:394, 39, and 429, respectively; a CDR-L1, CDR-L2, and CDR-L3 containing the amino acid sequence of SEQ ID NOs:395, 411, and 430, respectively; a CDR-L1, CDR-L2, and CDR-L3 containing the amino acid sequence of SEQ ID NOs:396, 412, and 431, respectively; a CDR-L1, CDR-L2, and CDR-L3 containing the amino acid sequence of SEQ ID NOs:396, 412, and 58, respectively; a CDR-L1, CDR-L2, and CDR-L3 containing the amino acid sequence of SEQ ID NOs:397, 413, and 432, respectively; a CDR-L1, CDR-L2, and CDR-L3 containing the amino acid sequence of SEQ ID NOs:398, 414, and 433, respectively; a CDR-L1, CDR-L2, and CDR-L3 containing the amino acid sequence of SEQ ID NOs:601, 602, and 603, respectively; a CDR-L1, CDR-L2, and CDR-L3 containing the amino acid sequence of SEQ ID NOs:614, 615, and 603, respectively; a CDR-L1, CDR-L2, and CDR-L3 containing the amino acid sequence of SEQ ID NOs:589, 590, and 591, respectively; a CDR-L1, CDR-L2, and CDR-L3 containing the amino acid sequence of SEQ ID NOs:607, 608, and 591, respectively; a CDR-L1, CDR-L2, and CDR-L3 containing the amino acid sequence of SEQ ID NOs:302, 304, and 306, respectively; or a CDR-L1, CDR-L2, and CDR-L3 containing the amino acid sequence of SEQ ID NOs:303, 305, and 307, respectively.

In some embodiments of any of the polynucleotides described herein, the $V_L$ region includes a CDR-L1, CDR-L2, and CDR-L3 selected from: a CDR-L1, CDR-L2, and CDR-L3 containing the amino acid sequence of SEQ ID NOs:26, 37, and 47, respectively; a CDR-L1, CDR-L2, and CDR-L3 containing the amino acid sequence of SEQ ID NOs:27, 38, and 48, respectively; a CDR-L1, CDR-L2, and CDR-L3 containing the amino acid sequence of SEQ ID NOs:28, 39, and 49, respectively; a CDR-L1, CDR-L2, and CDR-L3 containing the amino acid sequence of SEQ ID NOs:30, 39, and 51, respectively; a CDR-L1, CDR-L2, and CDR-L3 containing the amino acid sequence of SEQ ID NOs:31, 41, and 52, respectively; a CDR-L1, CDR-L2, and CDR-L3 containing the amino acid sequence of SEQ ID NOs:33, 43, and 55, respectively; a CDR-L1, CDR-L2, and CDR-L3 containing the amino acid sequence of SEQ ID NOs:34, 44, and 56, respectively; a CDR-L1, CDR-L2, and CDR-L3 containing the amino acid sequence of SEQ ID NOs:174, 179, and 185, respectively; a CDR-L1, CDR-L2, and CDR-L3 containing the amino acid sequence of SEQ ID NOs:174, 179, and 189, respectively; a CDR-L1, CDR-L2, and CDR-L3 containing the amino acid sequence of SEQ ID NOs:176, 181, and 190, respectively; a CDR-L1, CDR-L2, and CDR-L3 containing the amino acid sequence of SEQ ID NOs:177, 182, and 191, respectively; a CDR-L1, CDR-L2, and CDR-L3 containing the amino acid sequence of SEQ ID NOs:174, 179, and 192, respectively; a CDR-L1, CDR-L2, and CDR-L3 containing the amino acid sequence of SEQ ID NOs:178, 183, and 193, respectively; a CDR-L1, CDR-L2, and CDR-L3 containing the amino acid sequence of SEQ ID NOs:178, 183, and 194, respectively; a CDR-L1, CDR-L2, and CDR-L3 containing the amino acid sequence of SEQ ID NOs:30, 399, and 415, respectively; a CDR-L1, CDR-L2, and CDR-L3 containing the amino acid sequence of SEQ ID NOs:380, 400, and 416, respectively; a CDR-L1, CDR-L2, and CDR-L3 containing the amino acid sequence of SEQ ID NOs:33, 43, and 421, respectively; a CDR-L1, CDR-L2, and CDR-L3 containing the amino acid sequence of SEQ ID NOs:381, 401, and 417, respectively; a CDR-L1, CDR-L2, and CDR-L3 containing the amino acid sequence of SEQ ID NOs:382, 402, and 418, respectively; a CDR-L1, CDR-L2, and CDR-L3 containing the amino acid sequence of SEQ ID NOs:601, 602, and 603, respectively; a CDR-L1, CDR-L2, and CDR-L3 containing the amino acid sequence of SEQ ID NOs:614, 615, and 603, respectively; a CDR-L1, CDR-L2, and CDR-L3 containing the amino acid sequence of SEQ ID NOs:589, 590, and 591, respectively; a CDR-L1, CDR-L2, and CDR-L3 containing the amino acid sequence of SEQ ID NOs:607, 608, and 591, respectively; a CDR-L1, CDR-L2, and CDR-L3 containing the amino acid sequence of SEQ ID NOs:302, 304, and 306, respectively; or a CDR-L1, CDR-L2, and CDR-L3 containing the amino acid sequence of SEQ ID NOs:303, 305, and 307, respectively.

In some of any such embodiments, the $V_L$ region is or includes the amino acid sequence set forth in any of SEQ ID NOs: 116-127, 257-267, 326, 327, 534-550, 552-557, 610, 618, 775-777, or 833-849. In some aspects, the $V_L$ region is or contains the amino acid sequence set forth in any of SEQ ID NOs: 116, 117, 118, 120, 121, 124, 125, 258, 262, 263, 264, 265, 266, 267, 326, 327, 534, 535, 536, 537, 538, 610, 618, 775-777, or 833-849.

In some embodiments of any of the polynucleotides described herein, the $V_L$ region contains a CDR-L1, CDR-L2, and CDR-L3 including the amino acid sequence of SEQ ID NOs:601, 602, and 603, respectively; or the $V_L$ region contains a CDR-L1, CDR-L2, and CDR-L3 including the amino acid sequence of SEQ ID NOs:614, 615, and 603, respectively. In some cases, the $V_L$ region is or includes the amino acid sequence set forth in SEQ ID NO:618.

In some of any embodiments, the $V_H$ region is or comprises an amino acid sequence having at least 90%, 91%, 92%, 93%, 94%, 95%, 96%, 97%, 98% or 99% sequence identity to the $V_H$ region sequence of any of SEQ ID NOs:617, 110-115, 247-256, 324, 325, 518-531, 533, 609, 772-774, or 814-832; and the $V_L$ region is or comprises an amino acid sequence having at least 90%, 91%, 92%, 93%, 94%, 95%, 96%, 97%, 98%, or 99% sequence identity to the $V_L$ region sequence of any of SEQ ID NOs: 618, 116-127, 257-267, 326, 327, 534-550, 552-557, 610, 775-777, or 833-849.

In some of any embodiments, the $V_H$ region is or comprises a CDR-H1, CDR-H2 and CDR-H3 contained within the $V_H$ region amino acid sequence selected from any one of SEQ ID NOs: 617, 110-115, 247-256, 324, 325, 518-531, 533, 609, 772-774, or 814-832; and the $V_L$ region is or comprises a CDR-L1, CDR-L2 and CDR-L3 contained within the $V_L$ region amino acid sequence selected from any one of SEQ ID NOs: 618, 116-127, 257-267, 326, 327, 534-550, 552-557, 610, 775-777, or 833-849.

In some of any embodiments, the $V_H$ region is or comprises (a) a CDR-H1 comprising the sequence selected from any one of SEQ ID NOs: 593, 611, 1-3, 140-144, 288, 289, 294, 295, 507, 532, 596, or 604; (b) a CDR-H2 comprising the sequence selected from any one of SEQ ID NOs: 594, 612, 4-6, 145-148, 290, 291, 296, 297, 372-374, 513, 551, 597, or 605; and (c) a CDR-H3 comprising the sequence selected from any one of SEQ ID NOs: 595, 613, 7-11, 149-157, 279-287, 292, 293, 376-378, 517, or 606; and the $V_L$ region is or comprises (a) a CDR-L1 comprising the sequence selected from any one of SEQ ID NOs: 601, 614, 26-36, 174-178, 302, 303, 380-392, 394-398, 589, or 607; (b) a CDR-L2 comprising the sequence selected from any one of SEQ ID NOs: 602, 615, 37-46, 179-183, 304, 305, 399-409, 411-414, 590, or 608; and (c) a CDR-L3 comprising the sequence selected from any one of SEQ ID NOs: 603, 47-58, 184-194, 306, 307, 415-427, 429-433, or 591.

In some of any such embodiments, the $V_H$ region and the $V_L$ regions includes the amino acid sequence set forth in SEQ ID NOs:110 and 116, respectively, or a sequence of amino acids that has at least 90% identity to SEQ ID NO:110 and 116, respectively; the $V_H$ region and the $V_L$ regions contain the amino acid sequence set forth in SEQ ID NOs:111 and 117, respectively, or a sequence of amino acids that has at least 90% identity to SEQ ID NO:111 and 117, respectively; the $V_H$ region and the $V_L$ regions contain the amino acid sequence set forth in SEQ ID NOs:110 and 118, respectively, or a sequence of amino acids that has at least 90% identity to SEQ ID NO:110 and 118, respectively; the $V_H$ region and the $V_L$ regions contain the amino acid sequence set forth in SEQ ID NOs:110 and 119, respectively, or a sequence of amino acids that has at least 90% identity to SEQ ID NO:110 and 119, respectively; the $V_H$ region and the $V_L$ regions contain the amino acid sequence set forth in SEQ ID NOs:110 and 120, respectively, or a sequence of amino acids that has at least 90% identity to SEQ ID NO:110 and 120, respectively; the $V_H$ region and the $V_L$ regions contain the amino acid sequence set forth in SEQ ID NOs:110 and 121, respectively, or a sequence of amino acids that has at least 90% identity to SEQ ID NO:110 and 121, respectively; the $V_H$ region and the $V_L$ regions contain the amino acid sequence set forth in SEQ ID NOs:110 and 122, respectively, or a sequence of amino acids that has at least 90% identity to SEQ ID NO:110 and 122, respectively; the $V_H$ region and the $V_L$ regions contain the amino acid sequence set forth in SEQ ID NOs:110 and 123, respectively, or a sequence of amino acids that has at least 90% identity to SEQ ID NO:110 and 123, respectively; the $V_H$ region and the $V_L$ regions contain the amino acid sequence set forth in SEQ ID NOs:112 and 124, respectively, or a sequence of amino acids that has at least 90% identity to SEQ ID NO:112 and 124, respectively; the $V_H$ region and the $V_L$ regions contain the amino acid sequence set forth in SEQ ID NOs:113 and 125, respectively, or a sequence of amino acids that has at least 90% identity to SEQ ID NO:113 and 125, respectively; the $V_H$ region and the $V_L$ regions contain the amino acid sequence set forth in SEQ ID NOs:114 and 126, respectively, or a sequence of amino acids that has at least 90% identity to SEQ ID NO:114 and 126, respectively; the $V_H$ region and the $V_L$ regions contain the amino acid sequence set forth in SEQ ID NOs:115 and 127, respectively, or a sequence of amino acids that has at least 90% identity to SEQ ID NO:115 and 127, respectively; the $V_H$ region and the $V_L$ regions contain the amino acid sequence set forth in SEQ ID NOs:247 and 257, respectively, or a sequence of amino acids that has at least 90% identity to SEQ ID NO:247 and 257, respectively; the $V_H$ region and the $V_L$ regions contain the amino acid sequence set forth in SEQ ID NOs:248 and 258, respectively, or a sequence of amino acids that has at least 90% identity to SEQ ID NO:248 and 258, respectively; the $V_H$ region and the $V_L$ regions contain the amino acid sequence set forth in SEQ ID NOs:249 and 259, respectively, or a sequence of amino acids that has at least 90% identity to SEQ ID NO:249 and 259, respectively; the $V_H$ region and the $V_L$ regions contain the amino acid sequence set forth in SEQ ID NOs:250 and 260, respectively, or a sequence of amino acids that has at least 90% identity to SEQ ID NO:250 and 260, respectively; the $V_H$ region and the $V_L$ regions contain the amino acid sequence set forth in SEQ ID NOs:251 and 261, respectively, or a sequence of amino acids that has at least 90% identity to SEQ ID NO:251 and 261, respectively; the $V_H$ region and the $V_L$ regions contain the amino acid sequence set forth in SEQ ID NOs:252 and 262, respectively, or a sequence of amino acids that has at least 90% identity to SEQ ID NO:252 and 262, respectively; the $V_H$ region and the $V_L$ regions contain the amino acid sequence set forth in SEQ ID NOs:253 and 263, respectively, or a sequence of amino acids that has at least 90% identity to SEQ ID NO:253 and 263, respectively; the $V_H$ region and the $V_L$ regions contain the amino acid sequence set forth in SEQ ID NOs:254 and 264, respectively, or a sequence of amino acids that has at least 90% identity to SEQ ID NO:254 and 264, respectively; the $V_H$ region and the $V_L$ regions contain the amino acid sequence set forth in SEQ ID NOs:255 and 265, respectively, or a sequence of amino acids that has at least 90% identity to SEQ ID NO:255 and 265, respectively; the $V_H$ region and the $V_L$ regions contain the amino acid sequence set forth in SEQ ID NOs:256 and 266, respectively, or a sequence of amino acids that has at least 90% identity to SEQ ID NO:256 and 266, respectively; the $V_H$ region and the $V_L$ regions contain the amino acid sequence set forth in SEQ ID NOs:256 and 267, respectively, or a sequence of amino acids that has at least 90% identity to SEQ ID NO:256 and 267, respectively; the $V_H$ region and the $V_L$ regions contain the amino acid sequence set forth in SEQ ID NOs:518 and 534, respectively, or a sequence of amino acids that has at least 90% identity to SEQ ID NO:518 and 534, respectively; the $V_H$ region and the $V_L$ regions contain the amino acid sequence set forth in SEQ ID NOs:519 and 535, respectively, or a sequence of amino acids that has at least 90% identity to SEQ ID NO:519 and 535, respectively; the $V_H$ region and the $V_L$ regions contain the amino acid sequence set forth in SEQ ID NOs:115 and 536, respectively, or a sequence of amino acids that has at least 90% identity to SEQ ID NO:115 and 536, respectively; the $V_H$ region and the $V_L$ regions contain the amino acid sequence set forth in SEQ ID NOs:520 and 264, respectively, or a sequence of amino acids that has at least 90% identity to SEQ ID NO:520 and 264, respectively; the $V_H$ region and the $V_L$ regions contain the amino acid sequence set forth in SEQ ID NOs:521 and 537, respectively, or a sequence of amino acids that has at least 90% identity to SEQ ID NO:521 and 537, respectively; the $V_H$ region and the $V_L$ regions contain the amino acid sequence set forth in SEQ ID NOs:522 and 538, respectively, or a sequence of amino acids that has at least 90% identity to SEQ ID NO:522 and 538, respectively; the $V_H$ region and the $V_L$ regions contain the amino acid sequence set forth in SEQ ID NOs:523 and 539, respectively, or a sequence of amino acids that has at least 90% identity to SEQ ID NO:523 and 539, respectively; the $V_H$ region and the $V_L$ regions contain the amino acid sequence set forth in SEQ ID NOs:519 and 540, respectively, or a sequence of amino acids that has at least 90% identity to SEQ ID NO:519 and 540, respectively; the $V_H$ region and the $V_L$ regions contain the amino acid sequence set forth in SEQ ID NOs:524 and 541, respectively, or a sequence of amino acids that has at least 90% identity to SEQ ID NO:524 and 541, respectively; the $V_H$ region and the $V_L$ regions contain the amino acid sequence set forth in SEQ ID NOs:525 and 261, respectively, or a sequence of amino acids that has at least 90% identity to SEQ ID NO:525 and 261, respectively; the $V_H$ region and the $V_L$ regions contain the amino acid sequence set forth in SEQ ID NOs:526 and 542, respectively, or a sequence of amino acids that has at least 90% identity to SEQ ID NO:526 and 542, respectively; the $V_H$ region and the $V_L$ regions contain the amino acid sequence set forth in SEQ ID NOs:527 and 543, respectively, or a sequence of amino acids that has at least 90% identity to SEQ ID NO:527 and 543, respectively; the $V_H$ region and the $V_L$ regions contain the amino acid sequence set forth in SEQ ID NOs:528 and 544, respectively, or a sequence of amino acids that has at least 90% identity to SEQ ID NO:528 and 544, respectively; the $V_H$ region and the $V_L$ regions contain the amino acid sequence set forth in SEQ ID NOs:529 and 545, respectively, or a sequence of amino acids that has at least 90% identity to SEQ ID NO:529 and 545, respectively; the $V_H$ region and the $V_L$ regions contain the amino acid sequence set forth in SEQ ID NOs:528 and 546, respectively, or a sequence of amino acids that has at least 90% identity to SEQ ID NO:528 and 546, respectively; the $V_H$ region and the $V_L$ regions contain the amino acid sequence set forth in SEQ ID NOs:522 and 547, respectively, or a sequence of amino acids that has at least 90% identity to SEQ ID NO:522 and 547, respectively; the $V_H$ region and the $V_L$ regions contain the amino acid sequence set forth in SEQ ID NOs:256 and 548, respectively, or a sequence of amino acids that has at least 90% identity to SEQ ID NO:256 and 548, respectively; the $V_H$ region and the $V_L$ regions contain the amino acid sequence set forth in SEQ ID NOs:530 and 549, respectively, or a sequence of amino acids that has at least 90% identity to SEQ ID NO:530 and 549, respectively; the $V_H$ region and the $V_L$ regions contain the amino acid sequence set forth in SEQ ID NOs:531 and 550, respectively, or a sequence of amino acids that has at least 90% identity to SEQ ID NO:531 and 550, respectively; the $V_H$ region and the $V_L$ regions contain the amino acid sequence set forth in SEQ ID NOs:519 and 552, respectively, or a sequence of amino acids that has at least 90% identity to SEQ ID NO:519 and 552, respectively; the $V_H$ region and the $V_L$ regions contain the amino acid sequence set forth in SEQ ID NOs:110 and 553, respectively, or a sequence of amino acids that has at least 90% identity to SEQ ID NO:110 and 553, respectively; the $V_H$ region and the $V_L$ regions contain the amino acid sequence set forth in SEQ ID NOs:110 and 118, respectively, or a sequence of amino acids that has at least 90% identity to SEQ ID NO:110 and 118, respectively; the $V_H$ region and the $V_L$ regions contain the amino acid sequence set forth in SEQ ID NOs:533 and 554, respectively, or a sequence of amino acids that has at least 90% identity to SEQ ID NO:533 and 554, respectively; the $V_H$ region and the $V_L$ regions contain the amino acid sequence set forth in SEQ ID NOs:115 and 555, respectively, or a sequence of amino acids that has at least 90% identity to SEQ ID NO:115 and 555, respectively; the $V_H$ region and the $V_L$ regions contain the amino acid sequence set forth in SEQ ID NOs:524 and 556, respectively, or a sequence of amino acids that has at least 90% identity to SEQ ID NO:524 and 556, respectively; the $V_H$ region and the $V_L$ regions contain the amino acid sequence set forth in SEQ ID NOs:519 and 557, respectively, or a sequence of amino acids that has at least 90% identity to SEQ ID NO:519 and 557, respectively; the $V_H$ region and the $V_L$ regions contain the amino acid sequence set forth in SEQ ID NOs:609 and 610, respectively, or a sequence of amino acids that has at least 90% identity to SEQ ID NO:609 and 610, respectively; the $V_H$ region and the $V_L$ regions contain the amino acid sequence set forth in SEQ ID NOs:617 and 618, respectively, or a sequence of amino acids that has at least 90% identity to SEQ ID NO:617 and 618, respectively; the $V_H$ region and the $V_L$ regions contain the amino acid sequence set forth in SEQ ID NOs:324 and 326, respectively, or a sequence of amino acids that has at least 90% identity to SEQ ID NO:324 and 326, respectively; or the $V_H$ region and the $V_L$ regions contain the amino acid sequence set forth in SEQ ID NOs:325 and 327, respectively, or a sequence of amino acids that has at least 90% identity to SEQ ID NO:325 and 327, respectively; or the $V_H$ region and the $V_L$ regions contain the amino acid sequence set forth in SEQ ID NOs:772 and 775, respectively, or a sequence of amino acids that has at least 90% identity to SEQ ID NO:772 and 775, respectively; or the $V_H$ region and the $V_L$ regions contain the amino acid sequence set forth in SEQ ID NOs:773 and 776, respectively, or a sequence of amino acids that has at least 90% identity to SEQ ID NO:773 and 776, respectively; or the $V_H$ region and the $V_L$ regions contain the amino acid sequence set forth in SEQ ID NOs:774 and 777, respectively, or a sequence of amino acids that has at least 90% identity to SEQ ID NO:774 and 777, respectively; or the $V_H$ region and the $V_L$ regions contain the amino acid sequence set forth in SEQ ID NOs:815 and 833, respectively, or a sequence of amino acids that has at least 90% identity to SEQ ID NO:815 and 833, respectively; or the $V_H$ region and the $V_L$ regions contain the amino acid sequence set forth in SEQ ID NOs:816 and 834, respectively, or a sequence of amino acids that has at least 90% identity to SEQ ID NO:816 and 834, respectively; or the $V_H$ region and the $V_L$ regions contain the amino acid sequence set forth in SEQ ID NOs:817 and 835, respectively, or a sequence of amino acids that has at least 90% identity to SEQ ID NO:817 and 835, respectively; or the $V_H$ region and the $V_L$ regions contain the amino acid sequence set forth in SEQ ID NOs:818 and 836, respectively, or a sequence of amino acids that has at least 90% identity to SEQ ID NO:818 and 836, respectively; or the $V_H$ region and the $V_L$ regions contain the amino acid sequence set forth in SEQ ID NOs:819 and 837, respectively, or a sequence of amino acids that has at least 90% identity to SEQ ID NO:819 and 837, respectively; or the $V_H$ region and the $V_L$ regions contain the amino acid sequence set forth in SEQ ID NOs:820 and 838, respectively, or a sequence of amino acids that has at least 90% identity to SEQ ID NO:820 and 838, respectively; or the $V_H$ region and the $V_L$ regions contain the amino acid sequence set forth in SEQ ID NOs:821 and 839, respectively, or a sequence of amino acids that has at least 90% identity to SEQ ID NO:821 and 839, respectively; or the $V_H$ region and the $V_L$ regions contain the amino acid sequence set forth in SEQ ID NOs:822 and 840, respectively, or a sequence of amino acids that has at least 90% identity to SEQ ID NO:822 and 840, respectively; or the $V_H$ region and the $V_L$ regions contain the amino acid sequence set forth in SEQ ID NOs:823 and 841, respectively, or a sequence of amino acids that has at least 90% identity to SEQ ID NO:823 and 841, respectively; or the $V_H$ region and the $V_L$ regions contain the amino acid sequence set forth in SEQ ID NOs:824 and 842, respectively, or a sequence of amino acids that has at least 90% identity to SEQ ID NO:824 and 842, respectively; or the $V_H$ region and the $V_L$ regions contain the amino acid sequence set forth in SEQ ID NOs:825 and 843, respectively, or a sequence of amino acids that has at least 90% identity to SEQ ID NO:825 and 843, respectively; or the $V_H$ region and the $V_L$ regions contain the amino acid sequence set forth in SEQ ID NOs:826 and 844, respectively, or a sequence of amino acids that has at least 90% identity to SEQ ID NO:826 and 844, respectively; or the $V_H$ region and the $V_L$ regions contain the amino acid sequence set forth in SEQ ID NOs:827 and 845, respectively, or a sequence of amino acids that has at least 90% identity to SEQ ID NO:827 and 845, respectively; or the $V_H$ region and the $V_L$ regions contain the amino acid sequence set forth in SEQ ID NOs:828 and 846, respectively, or a sequence of amino acids that has at least 90% identity to SEQ ID NO:828 and 846, respectively; or the $V_H$ region and the $V_L$ regions contain the amino acid sequence set forth in SEQ ID NOs:829 and 847, respectively, or a sequence of amino acids that has at least 90% identity to SEQ ID NO:829 and 847, respectively; or the $V_H$ region and the $V_L$ regions contain the amino acid sequence set forth in SEQ ID NOs:830 and 847, respectively, or a sequence of amino acids that has at least 90% identity to SEQ ID NO:830 and 847, respectively; or the $V_H$ region and the $V_L$ regions contain the amino acid sequence set forth in SEQ ID NOs:831 and 848, respectively, or a sequence of amino acids that has at least 90% identity to SEQ ID NO:831 and 848, respectively; or the $V_H$ region and the $V_L$ regions contain the amino acid sequence set forth in SEQ ID NOs:832 and 849, respectively, or a sequence of amino acids that has at least 90% identity to SEQ ID NO:832 and 849, respectively.

In some embodiments of any of the polynucleotides described herein, the $V_H$ region and the $V_L$ regions encoded by the polynucleotides include the amino acid sequence set forth in SEQ ID NOs:110 and 116, respectively, or a sequence of amino acids that has at least 90% identity to SEQ ID NO:110 and 116, respectively; the $V_H$ region and the $V_L$ regions contain the amino acid sequence set forth in SEQ ID NOs:111 and 117, respectively, or a sequence of amino acids that has at least 90% identity to SEQ ID NO:111 and 117, respectively; the $V_H$ region and the $V_L$ regions contain the amino acid sequence set forth in SEQ ID NOs:110 and 118, respectively, or a sequence of amino acids that has at least 90% identity to SEQ ID NO:110 and 118, respectively; the $V_H$ region and the $V_L$ regions contain the amino acid sequence set forth in SEQ ID NOs:110 and 120, respectively, or a sequence of amino acids that has at least 90% identity to SEQ ID NO:110 and 120, respectively; the $V_H$ region and the $V_L$ regions contain the amino acid sequence set forth in SEQ ID NOs:110 and 121, respectively, or a sequence of amino acids that has at least 90% identity to SEQ ID NO:110 and 121, respectively; the $V_H$ region and the $V_L$ regions contain the amino acid sequence set forth in SEQ ID NOs:112 and 124, respectively, or a sequence of amino acids that has at least 90% identity to SEQ ID NO:112 and 124, respectively; the $V_H$ region and the $V_L$ regions contain the amino acid sequence set forth in SEQ ID NOs:113 and 125, respectively, or a sequence of amino acids that has at least 90% identity to SEQ ID NO:113 and 125, respectively; the $V_H$ region and the $V_L$ regions contain the amino acid sequence set forth in SEQ ID NOs:248 and 258, respectively, or a sequence of amino acids that has at least 90% identity to SEQ ID NO:248 and 258, respectively; the $V_H$ region and the $V_L$ regions contain the amino acid sequence set forth in SEQ ID NOs:252 and 262, respectively, or a sequence of amino acids that has at least 90% identity to SEQ ID NO:252 and 262, respectively; the $V_H$ region and the $V_L$ regions contain the amino acid sequence set forth in SEQ ID NOs:253 and 263, respectively, or a sequence of amino acids that has at least 90% identity to SEQ ID NO:253 and 263, respectively; the $V_H$ region and the $V_L$ regions contain the amino acid sequence set forth in SEQ ID NOs:254 and 264, respectively, or a sequence of amino acids that has at least 90% identity to SEQ ID NO:254 and 264, respectively; the $V_H$ region and the $V_L$ regions contain the amino acid sequence set forth in SEQ ID NOs:255 and 265, respectively, or a sequence of amino acids that has at least 90% identity to SEQ ID NO:255 and 265, respectively; the $V_H$ region and the $V_L$ regions contain the amino acid sequence set forth in SEQ ID NOs:256 and 266, respectively, or a sequence of amino acids that has at least 90% identity to SEQ ID NO:256 and 266, respectively; the $V_H$ region and the $V_L$ regions contain the amino acid sequence set forth in SEQ ID NOs:256 and 267, respectively, or a sequence of amino acids that has at least 90% identity to SEQ ID NO:256 and 267, respectively; the $V_H$ region and the $V_L$ regions contain the amino acid sequence set forth in SEQ ID NOs:518 and 534, respectively, or a sequence of amino acids that has at least 90% identity to SEQ ID NO:518 and 534, respectively; the $V_H$ region and the $V_L$ regions contain the amino acid sequence set forth in SEQ ID NOs:519 and 535, respectively, or a sequence of amino acids that has at least 90% identity to SEQ ID NO:519 and 535, respectively; the $V_H$ region and the $V_L$ regions contain the amino acid sequence set forth in SEQ ID NOs:115 and 536, respectively, or a sequence of amino acids that has at least 90% identity to SEQ ID NO:115 and 536, respectively; the $V_H$ region and the $V_L$ regions contain the amino acid sequence set forth in SEQ ID NOs:520 and 264, respectively, or a sequence of amino acids that has at least 90% identity to SEQ ID NO:520 and 264, respectively; the $V_H$ region and the $V_L$ regions contain the amino acid sequence set forth in SEQ ID NOs:521 and 537, respectively, or a sequence of amino acids that has at least 90% identity to SEQ ID NO:521 and 537, respectively; the $V_H$ region and the $V_L$ regions contain the amino acid sequence set forth in SEQ ID NOs:522 and 538, respectively, or a sequence of amino acids that has at least 90% identity to SEQ ID NO:522 and 538, respectively; the $V_H$ region and the $V_L$ regions contain the amino acid sequence set forth in SEQ ID NOs:609 and 610, respectively, or a sequence of amino acids that has at least 90% identity to SEQ ID NO:609 and 610, respectively; the $V_H$ region and the $V_L$ regions contain the amino acid sequence set forth in SEQ ID NOs:617 and 618, respectively, or a sequence of amino acids that has at least 90% identity to SEQ ID NO:617 and 618, respectively; the $V_H$ region and the $V_L$ regions contain the amino acid sequence set forth in SEQ ID NOs:324 and 326, respectively, or a sequence of amino acids that has at least 90% identity to SEQ ID NO:324 and 326, respectively; or the $V_H$ region and the $V_L$ regions contain the amino acid sequence set forth in SEQ ID NOs:325 and 327, respectively, or a sequence of amino acids that has at least 90% identity to SEQ ID NO:325 and 327, respectively; the $V_H$ region and the $V_L$ regions contain the amino acid sequence set forth in SEQ ID NOs:772 and 775, respectively, or a sequence of amino acids that has at least 90% identity to SEQ ID NO:772 and 775, respectively; the $V_H$ region and the $V_L$ regions contain the amino acid sequence set forth in SEQ ID NOs:773 and 776, respectively, or a sequence of amino acids that has at least 90% identity to SEQ ID NO:773 and 776, respectively; or the $V_H$ region and the $V_L$ regions contain the amino acid sequence set forth in SEQ ID NOs:774 and 777, respectively, or a sequence of amino acids that has at least 90% identity to SEQ ID NO:774 and 777, respectively; or the $V_H$ region and the $V_L$ regions contain the amino acid sequence set forth in SEQ ID NOs:815 and 833, respectively, or a sequence of amino acids that has at least 90% identity to SEQ ID NO:815 and 833, respectively; or the $V_H$ region and the $V_L$ regions contain the amino acid sequence set forth in SEQ ID NOs:816 and 834, respectively, or a sequence of amino acids that has at least 90% identity to SEQ ID NO:816 and 834, respectively; or the $V_H$ region and the $V_L$ regions contain the amino acid sequence set forth in SEQ ID NOs:817 and 835, respectively, or a sequence of amino acids that has at least 90% identity to SEQ ID NO:817 and 835, respectively; or the $V_H$ region and the $V_L$ regions contain the amino acid sequence set forth in SEQ ID NOs:818 and 836, respectively, or a sequence of amino acids that has at least 90% identity to SEQ ID NO:818 and 836, respectively; or the $V_H$ region and the $V_L$ regions contain the amino acid sequence set forth in SEQ ID NOs:819 and 837, respectively, or a sequence of amino acids that has at least 90% identity to SEQ ID NO:819 and 837, respectively; or the $V_H$ region and the $V_L$ regions contain the amino acid sequence set forth in SEQ ID NOs:820 and 838, respectively, or a sequence of amino acids that has at least 90% identity to SEQ ID NO:820 and 838, respectively; or the $V_H$ region and the $V_L$ regions contain the amino acid sequence set forth in SEQ ID NOs:821 and 839, respectively, or a sequence of amino acids that has at least 90% identity to SEQ ID NO:821 and 839, respectively; or the $V_H$ region and the $V_L$ regions contain the amino acid sequence set forth in SEQ ID NOs:822 and 840, respectively, or a sequence of amino acids that has at least 90% identity to SEQ ID NO:822 and 840, respectively; or the $V_H$ region and the $V_L$ regions contain the amino acid sequence set forth in SEQ ID NOs:823 and 841, respectively, or a sequence of amino acids that has at least 90% identity to SEQ ID NO:823 and 841, respectively; or the $V_H$ region and the $V_L$ regions contain the amino acid sequence set forth in SEQ ID NOs:824 and 842, respectively, or a sequence of amino acids that has at least 90% identity to SEQ ID NO:824 and 842, respectively; or the $V_H$ region and the $V_L$ regions contain the amino acid sequence set forth in SEQ ID NOs:825 and 843, respectively, or a sequence of amino acids that has at least 90% identity to SEQ ID NO:825 and 843, respectively; or the $V_H$ region and the $V_L$ regions contain the amino acid sequence set forth in SEQ ID NOs:826 and 844, respectively, or a sequence of amino acids that has at least 90% identity to SEQ ID NO:826 and 844, respectively; or the $V_H$ region and the $V_L$ regions contain the amino acid sequence set forth in SEQ ID NOs:827 and 845, respectively, or a sequence of amino acids that has at least 90% identity to SEQ ID NO:827 and 845, respectively; or the $V_H$ region and the $V_L$ regions contain the amino acid sequence set forth in SEQ ID NOs:828 and 846, respectively, or a sequence of amino acids that has at least 90% identity to SEQ ID NO:828 and 846, respectively; or the $V_H$ region and the $V_L$ regions contain the amino acid sequence set forth in SEQ ID NOs:829 and 847, respectively, or a sequence of amino acids that has at least 90% identity to SEQ ID NO:829 and 847, respectively; or the $V_H$ region and the $V_L$ regions contain the amino acid sequence set forth in SEQ ID NOs:830 and 847, respectively, or a sequence of amino acids that has at least 90% identity to SEQ ID NO:830 and 847, respectively; or the $V_H$ region and the $V_L$ regions contain the amino acid sequence set forth in SEQ ID NOs:831 and 848, respectively, or a sequence of amino acids that has at least 90% identity to SEQ ID NO:831 and 848, respectively; or the $V_H$ region and the $V_L$ regions contain the amino acid sequence set forth in SEQ ID NOs:832 and 849, respectively, or a sequence of amino acids that has at least 90% identity to SEQ ID NO:832 and 849, respectively.

In some of any embodiments, the $V_H$ region is or comprises the sequence of any of SEQ ID NOs: 617, 110-115, 247-256, 324, 325, 518-531, 533, 609, 772-774, or 814-832; and the $V_L$ region is or comprises the sequence of any of SEQ ID NOs: 618, 116-127, 257-267, 326, 327, 534-550, 552-557, 610, 775-777, or 833-849.

In some embodiments of any of the polynucleotides described herein, the fragment includes an scFv. In some embodiments, the $V_H$ region and the $V_L$ region are joined by a flexible linker. In some embodiments, the scFv includes a linker containing the amino acid sequence GGGGSGGGGSGGGGS (SEQ ID NO:361). In some embodiments, the $V_H$ region is amino-terminal to the $V_L$ region.

In some embodiments of any of the polynucleotides described herein, the antigen-binding domain includes the amino acid sequence selected from any one of SEQ ID NOs:128-139, 268-278, 329, 442, 478, 558-576, 578-583, 585, or 769-771 or an amino acid sequence having at least 90%, 91%, 92%, 93%, 94%, 95%, 96%, 97%, 98%, or 99% sequence identity to the amino acid sequence selected from any one of SEQ ID NOs: 128-139, 268-278, 329, 442, 478, 558-576, 578-583, 585, or 769-771. In some embodiments, the antigen-binding domain includes the amino acid sequence selected from any one of SEQ ID NOs:128-130, 132, 133, 136, 137, 269, 273-278, 329, 442, 478, 558-563 or 585 or an amino acid sequence having at least 90%, 91%, 92%, 93%, 94%, 95%, 96%, 97%, 98%, or 99% sequence identity to the amino acid sequence selected from any one of SEQ ID NOs: 128-130, 132, 133, 136, 137, 269, 273-278, 329, 442, 478, 558-563 or 585.

In some embodiments of any of the polynucleotides described herein, the nucleic acid encoding the antigen-binding domain includes (a) the sequence of nucleotides set forth in any of SEQ ID NOS: 330-352, 647, 648, 716 or 718; (b) a sequence of nucleotides that has at least 90% sequence identity to any of SEQ ID NOS: 330-352, 647, 648, 716 or 718; or (c) a degenerate sequence of (a) or (b). In some embodiments, the nucleic acid encoding the antigen-binding domain includes (a) the sequence of nucleotides set forth in any of SEQ ID NOS: 352, 647, 648, 716, or 718; (b) a sequence of nucleotides that has at least 90% sequence identity to any of SEQ ID NOS: 352, 647, 648, 716, or 718; or (c) a degenerate sequence of (a) or (b). In some embodiments, the nucleic acid encoding the antigen-binding domain is codon-optimized. In some embodiments, the nucleic acid encoding the antigen-binding domain includes the sequence of nucleotides set forth in any of SEQ ID NO: 440, 460, 715, 717 or 719. In some embodiments, the nucleic acid encoding the antigen-binding domain includes the sequence of nucleotides set forth in SEQ ID NO:460.

In some embodiments of any of the polynucleotides described herein, the $V_H$ region is carboxy-terminal to the $V_L$ region. In some embodiments, the scFv includes the amino acid sequence set forth in SEQ ID NOs:328 or 586, or an amino acid sequence having at least 90%, 91%, 92%, 93%, 94%, 95%, 96%, 97%, 98%, or 99% sequence identity to the amino acid sequence set forth in SEQ ID NO:328 or 586.

Provided are chimeric antigen receptors, comprising: (1) an extracellular antigen-binding domain that specifically binds human B cell maturation antigen (BCMA), wherein the extracellular antigen-binding domain comprises: (i) a variable heavy chain ($V_H$) comprising an amino acid sequence having at least 90%, 91%, 92%, 93%, 94%, 95%, 96%, 97%, 98%, or 99% sequence identity to the $V_H$ region sequence of SEQ ID NO: 617; and (ii) a variable light chain ($V_L$) region comprising an amino acid sequence having at least 90%, 91%, 92%, 93%, 94%, 95%, 96%, 97%, 98%, or 99% sequence identity to the $V_L$ region sequence of any of SEQ ID NO: 618; (2) a spacer set forth in SEQ ID NO: 649 or wherein the nucleic acid encoding the spacer is or comprises the sequence set forth in SEQ ID NO:622; (3) a transmembrane domain, optionally a transmembrane domain from a human CD28; and (4) an intracellular signaling region comprising a cytoplasmic signaling domain of a CD3-zeta (CD3ζ) chain and an intracellular signaling domain of a T cell costimulatory molecule. Also provided are polynucleotides encoding such a chimeric antigen receptor. In some of any embodiments, the $V_H$ region comprises a CDR-H1, CDR-H2 and CDR-H3 contained within the $V_H$ region sequence of SEQ ID NO: 617; and the $V_L$ region comprises a CDR-L1, CDR-L2 and CDR-L3 contained within the $V_L$ region sequence of SEQ ID NO: 618; or the $V_H$ region comprises a CDR-H1, CDR-H2, and CDR-H3 comprising the sequence of SEQ ID NOS:593, 594, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:596, 597, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:598, 599, and 595, respectively, and the $V_L$ region comprises a CDR-L1, CDR-L2, and CDR-L3 comprising the sequence of SEQ ID NOS:601, 602, and 603, respectively; or the $V_H$ region comprises a CDR-H1, CDR-H2, and CDR-H3 comprising the sequence of SEQ ID NOS:611, 612, and 613, respectively, and the $V_L$ region comprises a CDR-L1, CDR-L2, and CDR-L3 comprising the sequence of SEQ ID NOS:614, 615, and 603, respectively.

Provided are chimeric antigen receptors, comprising: (1) an extracellular antigen-binding domain that specifically binds human B cell maturation antigen (BCMA), wherein the extracellular antigen-binding domain comprises: a variable heavy ($V_H$) region comprising a CDR-H1, CDR-H2 and CDR-H3 contained within the $V_H$ region sequence of SEQ ID NO: 617; and a variable light ($V_L$) region comprising a CDR-L1, CDR-L2 and CDR-L3 contained within the $V_L$ region sequence of SEQ ID NO: 618; or the $V_H$ region comprises a CDR-H1, CDR-H2 and CDR-H3 contained within the $V_H$ region sequence of SEQ ID NO: 617; and the $V_L$ region comprises a CDR-L1, CDR-L2 and CDR-L3 contained within the $V_L$ region sequence of SEQ ID NO: 618; or the $V_H$ region comprises a CDR-H1, CDR-H2, and CDR-H3 comprising the sequence of SEQ ID NOS:593, 594, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:596, 597, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:598, 599, and 595, respectively, and the $V_L$ region comprises a CDR-L1, CDR-L2, and CDR-L3 comprising the sequence of SEQ ID NOS:601, 602, and 603, respectively; or the $V_H$ region comprises a CDR-H1, CDR-H2, and CDR-H3 comprising the sequence of SEQ ID NOS:611, 612, and 613, respectively, and the $V_L$ region comprises a CDR-L1, CDR-L2, and CDR-L3 comprising the sequence of SEQ ID NOS:614, 615, and 603, respectively; (2) a spacer set forth in SEQ ID NO: 649 or wherein the nucleic acid encoding the spacer is or comprises the sequence set forth in SEQ ID NO:622; (3) a transmembrane domain, optionally a transmembrane domain from a human CD28; and (4) an intracellular signaling region comprising a cytoplasmic signaling domain of a human CD3-zeta (CD3ζ) chain and an intracellular signaling domain of a human 4-1BB or a human CD28. Also provided are polynucleotides encoding such a chimeric antigen receptor. In some of any embodiments, the extracellular antigen-binding domain comprises the $V_H$ region sequence of SEQ ID NO:617 and the $V_L$ region sequence of SEQ ID NO:618.

In some embodiments, the receptor includes an antigen-binding domain that binds to the same or substantially the same epitope on BCMA, or competes for binding to BCMA with, any of the antibodies and fragments, or antibodies having the provided combinations of VH/VL or CDR sequences, described herein including in any of the foregoing embodiments. In some embodiments, the binding domain recognizes an epitope comprising a portion of one or more amino acid sequences within a BCMA polypeptide. In some aspects, such one or more amino acid sequences are or comprise: MLMAG (SEQ ID NO:640), YFDSL (SEQ ID NO:779), and QLRCSSNTPPL (SEQ ID NO:642). In some aspects, such one or more amino acid sequences are or comprise: MLMAG (SEQ ID NO:640), YFDSLL (SEQ ID NO:641), and QLRCSSNTPPL (SEQ ID NO:642). In some aspects, such one or more amino acid sequences are or comprise: MLMAG (SEQ ID NO:640), QNEYFDSLL (SEQ ID NO:780), and QLRCSSNTPPL (SEQ ID NO:642). In some aspects, such one or more amino acid sequences are or comprise: QNEYF (SEQ ID NO:637), CIPCQL (SEQ ID NO:638), and CQRYC (SEQ ID NO:639). In some aspects, such one or more amino acid sequences are or comprise: CSQNEYF (set forth in SEQ ID NO:410) and LLHACIPCQLR (set forth in SEQ ID NO:428).

In some embodiments of any of the polynucleotides described herein, the intracellular signaling region includes an activating cytoplasmic signaling domain. In some embodiments, the activating cytoplasmic signaling domain is capable of inducing a primary activation signal in a T cell, is a T cell receptor (TCR) component and/or includes an immunoreceptor tyrosine-based activation motif (ITAM). In some embodiments, the activating cytoplasmic signaling domain is or includes a cytoplasmic signaling domain of a zeta chain of a CD3-zeta (CD3ζ) chain or a functional variant or signaling portion thereof. In some embodiments, the activating cytoplasmic domain is human or is derived from a human protein. In some embodiments, the activating cytoplasmic domain is or includes the sequence set forth in SEQ ID NO:628 or a sequence of amino acids that has at least 90% sequence identity to SEQ ID NO:628.

In some embodiments of any of the polynucleotides described herein, the nucleic acid encoding the activating cytoplasmic domain is or includes the sequence set forth in SEQ ID NO:627 or is a codon-optimized sequence and/or degenerate sequence thereof. In other embodiments, the nucleic acid encoding the activating cytoplasmic signaling domain is or includes the sequence set forth in SEQ ID NO:652.

In some embodiments of any of the polynucleotides described herein, the intracellular signaling region further includes a costimulatory signaling region. In some embodiments, the costimulatory signaling region includes an intracellular signaling domain of a T cell costimulatory molecule or a signaling portion thereof. In some embodiments, the costimulatory signaling region includes an intracellular signaling domain of a CD28, a 4-1BB or an ICOS or a signaling portion thereof. In some embodiments, the costimulatory signaling region includes an intracellular signaling domain of 4-1BB. In some embodiments, the costimulatory signaling region is human or is derived from a human protein. In other embodiments, the costimulatory signaling region is or includes the sequence set forth in SEQ ID NO:626 or a sequence of amino acids that exhibits at least 90% sequence identity to the sequence set forth in SEQ ID NO: 626.

In some embodiments of any of the polynucleotides described herein, the nucleic acid encoding the costimulatory region is or includes the sequence set forth in SEQ ID NO:625 or is a codon-optimized sequence and/or degenerate sequence thereof. In some embodiments, the nucleic acid encoding the costimulatory signaling region includes the sequence set forth in SEQ ID NO:681. In some embodiments, the costimulatory signaling region is between the transmembrane domain and the intracellular signaling region. In some embodiments, the transmembrane domain is or includes a transmembrane domain derived from CD4, CD28, or CD8. In some embodiments, the transmembrane domain is or includes a transmembrane domain derived from a CD28. In some embodiments, the transmembrane domain is human or is derived from a human protein. In other embodiments, the transmembrane domain is or includes the sequence set forth in SEQ ID NO:624 or a sequence of amino acids that exhibits at least 90% sequence identity to SEQ ID NO:624.

In some embodiments of any of the polynucleotides described herein, the nucleic acid encoding the transmembrane domain is or includes the sequence set forth in SEQ ID NO:623 or is a codon-optimized sequence and/or degenerate sequence thereof. In some embodiments, the nucleic acid encoding the transmembrane domain includes the sequence set forth in SEQ ID NO:688. In some embodiments of any of the polynucleotides described herein, the encoded chimeric antigen receptor includes from its N to C terminus in order: the antigen-binding domain, the spacer, the transmembrane domain and the intracellular signaling domain.

In some of any of the embodiments, the polynucleotide comprises the sequence set forth in any of SEQ ID NOS: 751-756 or a sequence that exhibits at least 85%, 86%, 87%, 88%, 89%, 90%, 91%, 92%, 93%, 94%, 95%, 96%, 97%, 98%, or 99% sequence identity to the sequence set forth in any of SEQ ID NOS: 751-756 and the encoded receptor retains the function to bind to BCMA and retains the reduced RNA heterogeneity. In some of any of the embodiments, the polynucleotide comprises the sequence set forth in any of SEQ ID NOS: 755 and 756 or a sequence that exhibits at least 85%, 86%, 87%, 88%, 89%, 90%, 91%, 92%, 93%, 94%, 95%, 96%, 97%, 98%, or 99% sequence identity to the sequence set forth in any of SEQ ID NOS: 755 and 756 and the encoded receptor retains the function to bind to BCMA and retains the reduced RNA heterogeneity. In some of any of the embodiments, the polynucleotide comprises the sequence set forth in SEQ ID NOs:755 or a sequences that exhibits at least or at least about 90%, 91%, 92%, 93%, 94%, 95%, 96%, 97%, 98% or 99% sequence identity thereto and the encoded receptor retains the function to bind to BCMA and retains the reduced RNA heterogeneity. In some of any of the embodiments, the polynucleotide comprises the sequence set forth in SEQ ID NOs:755 and the encoded receptor retains the function to bind to BCMA and retains the reduced RNA heterogeneity.

In some embodiments, the polynucleotide further encodes a truncated receptor

Also provided are vectors comprising any of the polynucleotides described herein. In some of any embodiments, the vector is a viral vector. In some of any embodiments, the viral vector is a retroviral vector. In some of any embodiments, the viral vector is a lentiviral vector.

Provided in some aspects are chimeric antigen receptors encoded a polynucleotide of any of the embodiments described herein. In some embodiments, the chimeric antigen receptor includes: (a) an extracellular antigen-binding domain that specifically recognizes B cell maturation antigen (BCMA); (b) a spacer of at least 125 amino acids in length; (c) a transmembrane domain; and (d) an intracellular signaling region.

In some embodiments of any of the chimeric antigen receptors described herein, the spacer is derived from an immunoglobulin. In some embodiments, the spacer includes a sequence of a hinge region, a $C_H2$ and $C_H3$ region. In some embodiments of any of the chimeric antigen receptors described herein, one of more of the hinge, $C_H2$ and $C_H3$ is derived all or in part from IgG4 or IgG2. In some embodiments, the hinge, $C_H2$ and $C_H3$ is derived from IgG4. In some embodiments, one or more of the hinge, $C_H2$ and $C_H3$ is chimeric and includes sequence derived from IgG4 and IgG2. In some embodiments, the spacer includes an IgG4/2 chimeric hinge, an IgG2/4 $C_H2$, and an IgG4 $C_H3$ region.

In some embodiments of any of the chimeric antigen receptors described herein, the spacer is or includes (i) the sequence set forth in SEQ ID NO: 649; (ii) a functional variant of SEQ ID NO:649 that has at least 95%, 96%, 97%, 98% or 99% sequence identity to SEQ ID NO:649; or (iii) a contiguous portion of (i) or (ii) that is at least 125 amino acids in length. In some embodiments, the encoded spacer is or includes the sequence set forth in SEQ ID NO: 649.

Provided in other aspects are chimeric antigen receptors that include (a) an extracellular antigen-binding domain that specifically recognizes B cell maturation antigen (BCMA); (b) a spacer set forth in SEQ ID NO:649; (c) a transmembrane domain; and (d) an intracellular signaling region. In some embodiments of any of the chimeric antigen receptors described herein, the antigen-binding domain is an antibody fragment containing a variable heavy chain ($V_H$) and a variable light chain ($V_L$) region.

In some embodiments of any of the chimeric antigen receptors described herein, the $V_H$ region is or includes an amino acid sequence having at least 90%, 91%, 92%, 93%, 94%, 95%, 96%, 97%, 98% or 99% sequence identity to the $V_H$ region amino acid sequence set forth in any of SEQ ID NOs:110-115, 247-256, 324, 325, 518-531, 533, 609, 617, 772-774, or 814-832; and/or the $V_L$ region is or includes an amino acid sequence having at least 90%, 91%, 92%, 93%, 94%, 95%, 96%, 97%, 98%, or 99% sequence identity to the $V_L$ region amino acid sequence set forth in any of SEQ ID NOs:116-127, 257-267, 326, 327, 534-550, 552-557, 610, 618, 775-777, or 833-849.

In some embodiments of any of the chimeric antigen receptors described herein, the $V_H$ region is or includes an amino acid sequence having at least 90%, 91%, 92%, 93%, 94%, 95%, 96%, 97%, 98% or 99% sequence identity to the $V_H$ region amino acid sequence set forth in any of SEQ ID NOs: 110, 111, 112, 113, 115, 248, 252, 253, 254, 255, 256, 324, 325, 518, 519, 520, 521, 522, 609, 617, 772-774, or 814-832; and/or the $V_L$ region is or includes an amino acid sequence having at least 90%, 91%, 92%, 93%, 94%, 95%, 96%, 97%, 98%, or 99% sequence identity to the $V_L$ region amino acid sequence set forth in any of SEQ ID NOs: 116, 117, 118, 120, 121, 124, 125, 258, 262, 263, 264, 265, 266, 267, 326, 327, 534, 535, 536, 537, 538, 610, 618, 775-777, or 833-849.

In some embodiments of any of the chimeric antigen receptors described herein, the $V_H$ region is or includes a CDR-H1, CDR-H2 and CDR-H3 contained within the $V_H$ region amino acid sequence selected from any one of SEQ ID NOs:110-115, 247-256, 324, 325, 518-531, 533, 609, 617, 772-774, or 814-832; and/or the $V_L$ region is or includes a CDR-L1, CDR-L2 and CDR-L3 contained within the $V_L$ region amino acid sequence selected from any one of SEQ ID NOs:116-127, 257-267, 326, 327, 534-550, 552-557, 610, 618, 775-777, or 833-849.

In some embodiments of any of the chimeric antigen receptors described herein, the $V_H$ region is or includes a CDR-H1, CDR-H2 and CDR-H3 contained within the $V_H$ region amino acid sequence selected from any one of SEQ ID NOs: 110, 111, 112, 113, 115, 248, 252, 253, 254, 255, 256, 324, 325, 518, 519, 520, 521, 522, 609, 617, 772-774, or 814-832; and/or the $V_L$ region is or includes a CDR-L1, CDR-L2 and CDR-L3 contained within the $V_L$ region amino acid sequence selected from any one of SEQ ID NOs: 116, 117, 118, 120, 121, 124, 125, 258, 262, 263, 264, 265, 266, 267, 326, 327, 534, 535, 536, 537, 538, 610, 618, 775-777, or 833-849.

In some embodiments of any of the chimeric antigen receptors described herein, the $V_H$ region is or includes (a) a heavy chain complementarity determining region 1 (CDR-H1) containing the amino acid sequence selected from any one of SEQ ID NOs:1-3, 140-144, 288, 289, 294, 295, 507, 532, 593, 596, 604, 611; and/or (b) a heavy chain complementarity determining region 2 (CDR-H2) containing the amino acid sequence selected from any one of SEQ ID NOs:4-6, 145-148, 290, 291, 296, 297, 372-374, 513, 551, 594, 597, 605, 612; and (c) a heavy chain complementarity determining region 3 (CDR-H3) containing the amino acid sequence selected from any one of SEQ ID NOs:7-11, 149-157, 279-287, 292, 293, 376-378, 517, 595, 606, 613; and/or the $V_L$ region is or includes (a) a light chain complementarity determining region 1 (CDR-L1) containing the amino acid sequence selected from any one of SEQ ID NOs:26-36, 174-178, 302, 303, 380-392, 394-398, 589, 601, 607 or 614; (b) a light chain complementarity determining region 2 (CDR-L2) containing the amino acid sequence selected from any one of SEQ ID NOs:37-46, 179-183, 304, 305, 399-409, 411-414, 590, 602, 608 or 615; and (c) a light chain complementarity determining region 3 (CDR-L3) containing the amino acid sequence selected from any one of SEQ ID NOs:47-58, 184-194, 306, 307, 415-427, 429-433, 591, or 603.

In some embodiments of any of the chimeric antigen receptors described herein, the $V_H$ region is or includes (a) a heavy chain complementarity determining region 1 (CDR-H1) containing the amino acid sequence selected from any one of SEQ ID NOs: 1, 2, 3, 141, 143, 144, 288, 289, 507, 593, 604, 611; and/or (b) a heavy chain complementarity determining region 2 (CDR-H2) containing the amino acid sequence selected from any one of SEQ ID NOs: 4, 5, 6, 145, 147, 148, 290, 291, 372, 513, 594, 605 or 612; and (c) a heavy chain complementarity determining region 3 (CDR-H3) containing the amino acid sequence selected from any one of SEQ ID NOs: 7, 8, 9, 10, 149, 153, 154, 155, 156, 157, 292, 293, 376, 517, 595, 606 or 613; and/or the $V_L$ region is or includes (a) a light chain complementarity determining region 1 (CDR-L1) containing the amino acid sequence selected from any one of SEQ ID NOs: 26, 27, 28, 30, 31, 33, 34, 174, 176, 177, 178, 302, 303, 380, 381, 382, 589, 601, 607 or 614; (b) a light chain complementarity determining region 2 (CDR-L2) containing the amino acid sequence selected from any one of SEQ ID NOs: 37, 38, 39, 41, 43, 44, 179, 181, 182, 183, 304, 305, 399, 400, 401, 402, 590, 602, 608 or 615; and (c) a light chain complementarity determining region 3 (CDR-L3) containing the amino acid sequence selected from any one of SEQ ID NOs: 47, 48, 49, 51, 52, 55, 56, 185, 189, 190, 191, 192, 193, 194, 306, 307, 415, 417, 418, 421, 591, or 603. In some embodiments of any of the chimeric antigen receptors described herein, the $V_H$ region includes a CDR-H1, CDR-H2, and CDR-H3, selected from: a CDR-H1, CDR-H2, and CDR-H3 containing the amino acid sequence of SEQ ID NOs:1, 4, and 7, respectively; a CDR-H1, CDR-H2, and CDR-H3 containing the amino acid sequence of SEQ ID NOs:2, 5, and 8, respectively; a CDR-H1, CDR-H2, and CDR-H3 containing the amino acid sequence of SEQ ID NOs:2, 5, and 9, respectively; a CDR-H1, CDR-H2, and CDR-H3 containing the amino acid sequence of SEQ ID NOs:2, 5, and 10, respectively; a CDR-H1, CDR-H2, and CDR-H3 containing the amino acid sequence of SEQ ID NOs:3, 6, and 11, respectively; a CDR-H1, CDR-H2, and CDR-H3 containing the amino acid sequence of SEQ ID NOs:140, 145, and 149, respectively; a CDR-H1, CDR-H2, and CDR-H3 containing the amino acid sequence of SEQ ID NOs:141, 145, and 149, respectively; a CDR-H1, CDR-H2, and CDR-H3 containing the amino acid sequence of SEQ ID NOs:141, 145, and 150, respectively; a CDR-H1, CDR-H2, and CDR-H3 containing the amino acid sequence of SEQ ID NOs:142, 146, and 151, respectively; a CDR-H1, CDR-H2, and CDR-H3 containing the amino acid sequence of SEQ ID NOs:2, 5, and 152, respectively; a CDR-H1, CDR-H2, and CDR-H3 containing the amino acid sequence of SEQ ID NOs:143, 147, and 153, respectively; a CDR-H1, CDR-H2, and CDR-H3 containing the amino acid sequence of SEQ ID NOs:144, 148, and 154, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:2, 5, and 156, respectively; a CDR-H1, CDR-H2, and CDR-H3 containing the amino acid sequence of SEQ ID NOs:2, 5, and 157, respectively; a CDR-H1, CDR-H2, and CDR-H3 containing the amino acid sequence of SEQ ID NOs:2, 6, and 376, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:3, 372, and 376, respectively; a CDR-H1, CDR-H2, and CDR-H3 containing the amino acid sequence of SEQ ID NOs:3, 6, and 376, respectively; a CDR-H1, CDR-H2, and CDR-H3 containing the amino acid sequence of SEQ ID NOs:3, 6, and 377, respectively; a CDR-H1, CDR-H2, and CDR-H3 containing the amino acid sequence of SEQ ID NOs:2, 373, and 152, respectively; a CDR-H1, CDR-H2, and CDR-H3 containing the amino acid sequence of SEQ ID NOs:2, 5, and 378, respectively; a CDR-H1, CDR-H2, and CDR-H3 containing the amino acid sequence of SEQ ID NOs:2, 374, and 9, respectively; a CDR-H1, CDR-H2, and CDR-H3 containing the amino acid sequence of SEQ ID NOs:593, 594, and 595, respectively; a CDR-H1, CDR-H2, and CDR-H3 containing the amino acid sequence of SEQ ID NOs:611, 612, and 613, respectively; a CDR-H1, CDR-H2, and CDR-H3 containing the amino acid sequence of SEQ ID NOs:507, 513, and 517, respectively; a CDR-H1, CDR-H2, and CDR-H3 containing the amino acid sequence of SEQ ID NOs:604, 605, and 606, respectively; a CDR-H1, CDR-H2, and CDR-H3 containing the amino acid sequence of SEQ ID NOs:288, 290, and 292, respectively; or a CDR-H1, CDR-H2, and CDR-H3 containing the amino acid sequence of SEQ ID NOs:289, 291, and 293, respectively;

In some embodiments of any of the chimeric antigen receptors described herein, the $V_H$ region includes a CDR-H1, CDR-H2, and CDR-H3, selected from: a CDR-H1, CDR-H2, and CDR-H3 containing the amino acid sequence of SEQ ID NOs:1, 4, and 7, respectively; a CDR-H1, CDR-H2, and CDR-H3 containing the amino acid sequence of SEQ ID NOs:2, 5, and 8, respectively; a CDR-H1, CDR-H2, and CDR-H3 containing the amino acid sequence of SEQ ID NOs:2, 5, and 9, respectively; a CDR-H1, CDR-H2, and CDR-H3 containing the amino acid sequence of SEQ ID NOs:2, 5, and 10, respectively; a CDR-H1, CDR-H2, and CDR-H3 containing the amino acid sequence of SEQ ID NOs:141, 145, and 149, respectively; a CDR-H1, CDR-H2, and CDR-H3 containing the amino acid sequence of SEQ ID NOs:143, 147, and 153, respectively; a CDR-H1, CDR-H2, and CDR-H3 containing the amino acid sequence of SEQ ID NOs:144, 148, and 154, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:2, 5, and 156, respectively; a CDR-H1, CDR-H2, and CDR-H3 containing the amino acid sequence of SEQ ID NOs:2, 5, and 157, respectively; a CDR-H1, CDR-H2, and CDR-H3 containing the amino acid sequence of SEQ ID NOs:2, 6, and 376, respectively; a CDR-H1, CDR-H2, and CDR-H3 containing the amino acid sequence of SEQ ID NOs:3, 6, and 155, respectively; a CDR-H1, CDR-H2, and CDR-H3 containing the amino acid sequence of SEQ ID NOs:3, 372, and 376, respectively; a CDR-H1, CDR-H2, and CDR-H3 containing the amino acid sequence of SEQ ID NOs:3, 6, and 376, respectively; a CDR-H1, CDR-H2, and CDR-H3 containing the amino acid sequence of SEQ ID NOs:593, 594, and 595, respectively; a CDR-H1, CDR-H2, and CDR-H3 containing the amino acid sequence of SEQ ID NOs:611, 612, and 613, respectively; a CDR-H1, CDR-H2, and CDR-H3 containing the amino acid sequence of SEQ ID NOs:507, 513, and 517, respectively; a CDR-H1, CDR-H2, and CDR-H3 containing the amino acid sequence of SEQ ID NOs:604, 605, and 606, respectively; a CDR-H1, CDR-H2, and CDR-H3 containing the amino acid sequence of SEQ ID NOs:288, 290, and 292, respectively; or a CDR-H1, CDR-H2, and CDR-H3 containing the amino acid sequence of SEQ ID NOs:289, 291, and 293, respectively;

In some embodiments of any of the chimeric antigen receptors described herein, the $V_H$ region is or includes the amino acid sequence set forth in any of SEQ ID NOs: 110-115, 247-256, 324, 325, 518-531, 533, 609, 617, 772-774, or 814-832. In some embodiments of any of the chimeric antigen receptors described herein, the $V_H$ region is or includes the amino acid sequence set forth in any of SEQ ID NOs: 110, 111, 112, 113, 115, 248, 252, 253, 254, 255, 256, 324, 325, 518, 519, 520, 521, 522, 609, 617, 772-774, or 814-832. In some embodiments, the $V_H$ region includes a CDR-H1, CDR-H2, and CDR-H3 containing the amino acid sequence of SEQ ID NOs:593, 594, and 595, respectively; or the $V_H$ region includes a CDR-H1, CDR-H2, and CDR-H3 containing the amino acid sequence of SEQ ID NOs:611, 612, and 613, respectively. In some embodiments, the $V_H$ region is or includes the amino acid sequence set forth in SEQ ID NO:617.

In some embodiments of any of the chimeric antigen receptors described herein, the $V_L$ region includes a CDR-L1, CDR-L2, and CDR-L3 selected from: a CDR-L1, CDR-L2, and CDR-L3 containing the amino acid sequence of SEQ ID NOs:26, 37, and 47, respectively; a CDR-L1, CDR-L2, and CDR-L3 containing the amino acid sequence of SEQ ID NOs:27, 38, and 48, respectively; a CDR-L1, CDR-L2, and CDR-L3 containing the amino acid sequence of SEQ ID NOs:28, 39, and 49, respectively; a CDR-L1, CDR-L2, and CDR-L3 containing the amino acid sequence of SEQ ID NOs:29, 40, and 50, respectively; a CDR-L1, CDR-L2, and CDR-L3 containing the amino acid sequence of SEQ ID NOs:30, 39, and 51, respectively; a CDR-L1, CDR-L2, and CDR-L3 containing the amino acid sequence of SEQ ID NOs:31, 41, and 52, respectively; a CDR-L1, CDR-L2, and CDR-L3 containing the amino acid sequence of SEQ ID NOs:32, 42, and 53, respectively; a CDR-L1, CDR-L2, and CDR-L3 containing the amino acid sequence of SEQ ID NOs:30, 39, and 54, respectively; a CDR-L1, CDR-L2, and CDR-L3 containing the amino acid sequence of SEQ ID NOs:33, 43, and 55, respectively; a CDR-L1, CDR-L2, and CDR-L3 containing the amino acid sequence of SEQ ID NOs:34, 44, and 56, respectively; a CDR-L1, CDR-L2, and CDR-L3 containing the amino acid sequence of SEQ ID NOs:35, 45, and 57, respectively; a CDR-L1, CDR-L2, and CDR-L3 containing the amino acid sequence of SEQ ID NOs:36, 46, and 58, respectively; a CDR-L1, CDR-L2, and CDR-L3 containing the amino acid sequence of SEQ ID NOs:174, 179, and 184, respectively; a CDR-L1, CDR-L2, and CDR-L3 containing the amino acid sequence of SEQ ID NOs:174, 179, and 185, respectively; a CDR-L1, CDR-L2, and CDR-L3 containing the amino acid sequence of SEQ ID NOs:174, 179, and 186, respectively; a CDR-L1, CDR-L2, and CDR-L3 containing the amino acid sequence of SEQ ID NOs:174, 179, and 187, respectively; a CDR-L1, CDR-L2, and CDR-L3 containing the amino acid sequence of SEQ ID NOs:175, 180, and 188, respectively; a CDR-L1, CDR-L2, and CDR-L3 containing the amino acid sequence of SEQ ID NOs:174, 179, and 189, respectively; a CDR-L1, CDR-L2, and CDR-L3 containing the amino acid sequence of SEQ ID NOs:176, 181, and 190, respectively; a CDR-L1, CDR-L2, and CDR-L3 containing the amino acid sequence of SEQ ID NOs:177, 182, and 191, respectively; a CDR-L1, CDR-L2, and CDR-L3 containing the amino acid sequence of SEQ ID NOs:174, 179, and 192, respectively; a CDR-L1, CDR-L2, and CDR-L3 containing the amino acid sequence of SEQ ID NOs:178, 183, and 193, respectively; a CDR-L1, CDR-L2, and CDR-L3 containing the amino acid sequence of SEQ ID NOs:178, 183, and 194, respectively; a CDR-L1, CDR-L2, and CDR-L3 containing the amino acid sequence of SEQ ID NOs:30, 399, and 415, respectively; a CDR-L1, CDR-L2, and CDR-L3 containing the amino acid sequence of SEQ ID NOs:380, 400, and 416, respectively; a CDR-L1, CDR-L2, and CDR-L3 containing the amino acid sequence of SEQ ID NOs:33, 43, and 421, respectively; a CDR-L1, CDR-L2, and CDR-L3 containing the amino acid sequence of SEQ ID NOs:381, 401, and 417, respectively; a CDR-L1, CDR-L2, and CDR-L3 containing the amino acid sequence of SEQ ID NOs:382, 402, and 418, respectively; a CDR-L1, CDR-L2, and CDR-L3 containing the amino acid sequence of SEQ ID NOs:383, 403, and 419, respectively; a CDR-L1, CDR-L2, and CDR-L3 containing the amino acid sequence of SEQ ID NOs:384, 39, and 54, respectively; a CDR-L1, CDR-L2, and CDR-L3 containing the amino acid sequence of SEQ ID NOs:385, 180, and 58, respectively; a CDR-L1, CDR-L2, and CDR-L3 containing the amino acid sequence of SEQ ID NOs:175, 180, and 188, respectively; a CDR-L1, CDR-L2, and CDR-L3 containing the amino acid sequence of SEQ ID NOs:386, 404, and 420, respectively; a CDR-L1, CDR-L2, and CDR-L3 containing the amino acid sequence of SEQ ID NOs:387, 405, and 422, respectively; a CDR-L1, CDR-L2, and CDR-L3 containing the amino acid sequence of SEQ ID NOs:388, 406, and 423, respectively; a CDR-L1, CDR-L2, and CDR-L3 containing the amino acid sequence of SEQ ID NOs:388, 407, and 424, respectively; a CDR-L1, CDR-L2, and CDR-L3 containing the amino acid sequence of SEQ ID NOs:389, 408, and 425, respectively; a CDR-L1, CDR-L2, and CDR-L3 containing the amino acid sequence of SEQ ID NOs:390, 183, and 193, respectively; a CDR-L1, CDR-L2, and CDR-L3 containing the amino acid sequence of SEQ ID NOs:391, 409, and 426, respectively; a CDR-L1, CDR-L2, and CDR-L3 containing the amino acid sequence of SEQ ID NOs:392, 40, and 427, respectively; a CDR-L1, CDR-L2, and CDR-L3 containing the amino acid sequence of SEQ ID NOs:394, 39, and 429, respectively; a CDR-L1, CDR-L2, and CDR-L3 containing the amino acid sequence of SEQ ID NOs:395, 411, and 430, respectively; a CDR-L1, CDR-L2, and CDR-L3 containing the amino acid sequence of SEQ ID NOs:396, 412, and 431, respectively; a CDR-L1, CDR-L2, and CDR-L3 containing the amino acid sequence of SEQ ID NOs:396, 412, and 58, respectively; a CDR-L1, CDR-L2, and CDR-L3 containing the amino acid sequence of SEQ ID NOs:397, 413, and 432, respectively; a CDR-L1, CDR-L2, and CDR-L3 containing the amino acid sequence of SEQ ID NOs:398, 414, and 433, respectively; a CDR-L1, CDR-L2, and CDR-L3 containing the amino acid sequence of SEQ ID NOs:601, 602, and 603, respectively; a CDR-L1, CDR-L2, and CDR-L3 containing the amino acid sequence of SEQ ID NOs:614, 615, and 603, respectively; a CDR-L1, CDR-L2, and CDR-L3 containing the amino acid sequence of SEQ ID NOs:589, 590, and 591, respectively; a CDR-L1, CDR-L2, and CDR-L3 containing the amino acid sequence of SEQ ID NOs:607, 608, and 591, respectively; a CDR-L1, CDR-L2, and CDR-L3 containing the amino acid sequence of SEQ ID NOs: 302, 304, and 306, respectively; or a CDR-L1, CDR-L2, and CDR-L3 containing the amino acid sequence of SEQ ID NOs:303, 305, and 307, respectively.

In some embodiments of any of the chimeric antigen receptors described herein, the $V_L$ region includes a CDR-L1, CDR-L2, and CDR-L3 selected from: a CDR-L1, CDR-L2, and CDR-L3 containing the amino acid sequence of SEQ ID NOs:26, 37, and 47, respectively; a CDR-L1, CDR-L2, and CDR-L3 containing the amino acid sequence of SEQ ID NOs:27, 38, and 48, respectively; a CDR-L1, CDR-L2, and CDR-L3 containing the amino acid sequence of SEQ ID NOs:28, 39, and 49, respectively; a CDR-L1, CDR-L2, and CDR-L3 containing the amino acid sequence of SEQ ID NOs:30, 39, and 51, respectively; a CDR-L1, CDR-L2, and CDR-L3 containing the amino acid sequence of SEQ ID NOs:31, 41, and 52, respectively; a CDR-L1, CDR-L2, and CDR-L3 containing the amino acid sequence of SEQ ID NOs:33, 43, and 55, respectively; a CDR-L1, CDR-L2, and CDR-L3 containing the amino acid sequence of SEQ ID NOs:34, 44, and 56, respectively; a CDR-L1, CDR-L2, and CDR-L3 containing the amino acid sequence of SEQ ID NOs:174, 179, and 185, respectively; a CDR-L1, CDR-L2, and CDR-L3 containing the amino acid sequence of SEQ ID NOs:174, 179, and 189, respectively; a CDR-L1, CDR-L2, and CDR-L3 containing the amino acid sequence of SEQ ID NOs:176, 181, and 190, respectively; a CDR-L1, CDR-L2, and CDR-L3 containing the amino acid sequence of SEQ ID NOs:177, 182, and 191, respectively; a CDR-L1, CDR-L2, and CDR-L3 containing the amino acid sequence of SEQ ID NOs:174, 179, and 192, respectively; a CDR-L1, CDR-L2, and CDR-L3 containing the amino acid sequence of SEQ ID NOs:178, 183, and 193, respectively; a CDR-L1, CDR-L2, and CDR-L3 containing the amino acid sequence of SEQ ID NOs:178, 183, and 194, respectively; a CDR-L1, CDR-L2, and CDR-L3 containing the amino acid sequence of SEQ ID NOs:30, 399, and 415, respectively; a CDR-L1, CDR-L2, and CDR-L3 containing the amino acid sequence of SEQ ID NOs:380, 400, and 416, respectively; a CDR-L1, CDR-L2, and CDR-L3 containing the amino acid sequence of SEQ ID NOs:33, 43, and 421, respectively; a CDR-L1, CDR-L2, and CDR-L3 containing the amino acid sequence of SEQ ID NOs:381, 401, and 417, respectively; a CDR-L1, CDR-L2, and CDR-L3 containing the amino acid sequence of SEQ ID NOs:382, 402, and 418, respectively; a CDR-L1, CDR-L2, and CDR-L3 containing the amino acid sequence of SEQ ID NOs:601, 602, and 603, respectively; a CDR-L1, CDR-L2, and CDR-L3 containing the amino acid sequence of SEQ ID NOs:614, 615, and 603, respectively; a CDR-L1, CDR-L2, and CDR-L3 containing the amino acid sequence of SEQ ID NOs:589, 590, and 591, respectively; a CDR-L1, CDR-L2, and CDR-L3 containing the amino acid sequence of SEQ ID NOs:607, 608, and 591, respectively; a CDR-L1, CDR-L2, and CDR-L3 containing the amino acid sequence of SEQ ID NOs: 302, 304, and 306, respectively; or a CDR-L1, CDR-L2, and CDR-L3 containing the amino acid sequence of SEQ ID NOs:303, 305, and 307, respectively.

In some embodiments of any of the chimeric antigen receptors described herein, the $V_L$ region is or includes the amino acid sequence set forth in any of SEQ ID NOs: 116-127, 257-267, 326, 327, 534-550, 552-557, 610, 618, 775-777, or 833-849. In some embodiments of any of the chimeric antigen receptors described herein, the $V_L$ region is or includes the amino acid sequence set forth in any of SEQ ID NOs: 116, 117, 118, 120, 121, 124, 125, 258, 262, 263, 264, 265, 266, 267, 326, 327, 534, 535, 536, 537, 538, 610, 618, 775-777, or 833-849.

In some embodiments of any of the chimeric antigen receptors described herein, the $V_L$ region includes a CDR-L1, CDR-L2, and CDR-L3 containing the amino acid sequence of SEQ ID NOs:601, 602, and 603, respectively; or the $V_L$ region includes a CDR-L1, CDR-L2, and CDR-L3 containing the amino acid sequence of SEQ ID NOs:614, 615, and 603, respectively;

In some embodiments of any of the chimeric antigen receptors described herein, the $V_L$ region is or includes the amino acid sequence set forth in SEQ ID NO:618. In some embodiments of any of the chimeric antigen receptors described herein, the $V_H$ region and the $V_L$ regions contain the amino acid sequence set forth in SEQ ID NOs:110 and 116, respectively, or a sequence of amino acids that has at least 90% identity to SEQ ID NO:110 and 116, respectively; the $V_H$ region and the $V_L$ regions contain the amino acid sequence set forth in SEQ ID NOs:111 and 117, respectively, or a sequence of amino acids that has at least 90% identity to SEQ ID NO:111 and 117, respectively; the $V_H$ region and the $V_L$ regions contain the amino acid sequence set forth in SEQ ID NOs:110 and 118, respectively, or a sequence of amino acids that has at least 90% identity to SEQ ID NO:110 and 118, respectively; the V$_H$ region and the V$_L$ regions contain the amino acid sequence set forth in SEQ ID NOs:110 and 119, respectively, or a sequence of amino acids that has at least 90% identity to SEQ ID NO:110 and 119, respectively; the V$_H$ region and the V$_L$ regions contain the amino acid sequence set forth in SEQ ID NOs:110 and 120, respectively, or a sequence of amino acids that has at least 90% identity to SEQ ID NO:110 and 120, respectively; the V$_H$ region and the V$_L$ regions contain the amino acid sequence set forth in SEQ ID NOs:110 and 121, respectively, or a sequence of amino acids that has at least 90% identity to SEQ ID NO:110 and 121, respectively; the V$_H$ region and the V$_L$ regions contain the amino acid sequence set forth in SEQ ID NOs:110 and 122, respectively, or a sequence of amino acids that has at least 90% identity to SEQ ID NO:110 and 122, respectively; the V$_H$ region and the V$_L$ regions contain the amino acid sequence set forth in SEQ ID NOs:110 and 123, respectively, or a sequence of amino acids that has at least 90% identity to SEQ ID NO:110 and 123, respectively; the V$_H$ region and the V$_L$ regions contain the amino acid sequence set forth in SEQ ID NOs:112 and 124, respectively, or a sequence of amino acids that has at least 90% identity to SEQ ID NO:112 and 124, respectively; the V$_H$ region and the V$_L$ regions contain the amino acid sequence set forth in SEQ ID NOs:113 and 125, respectively, or a sequence of amino acids that has at least 90% identity to SEQ ID NO:113 and 125, respectively; the V$_H$ region and the V$_L$ regions contain the amino acid sequence set forth in SEQ ID NOs:114 and 126, respectively, or a sequence of amino acids that has at least 90% identity to SEQ ID NO:114 and 126, respectively; the V$_H$ region and the V$_L$ regions contain the amino acid sequence set forth in SEQ ID NOs:115 and 127, respectively, or a sequence of amino acids that has at least 90% identity to SEQ ID NO:115 and 127, respectively; the V$_H$ region and the V$_L$ regions contain the amino acid sequence set forth in SEQ ID NOs:247 and 257, respectively, or a sequence of amino acids that has at least 90% identity to SEQ ID NO:247 and 257, respectively; the V$_H$ region and the V$_L$ regions contain the amino acid sequence set forth in SEQ ID NOs:248 and 258, respectively, or a sequence of amino acids that has at least 90% identity to SEQ ID NO:248 and 258, respectively; the V$_H$ region and the V$_L$ regions contain the amino acid sequence set forth in SEQ ID NOs:249 and 259, respectively, or a sequence of amino acids that has at least 90% identity to SEQ ID NO:249 and 259, respectively; the V$_H$ region and the V$_L$ regions contain the amino acid sequence set forth in SEQ ID NOs:250 and 260, respectively, or a sequence of amino acids that has at least 90% identity to SEQ ID NO:250 and 260, respectively; the V$_H$ region and the V$_L$ regions contain the amino acid sequence set forth in SEQ ID NOs:251 and 261, respectively, or a sequence of amino acids that has at least 90% identity to SEQ ID NO:251 and 261, respectively; the V$_H$ region and the V$_L$ regions contain the amino acid sequence set forth in SEQ ID NOs:252 and 262, respectively, or a sequence of amino acids that has at least 90% identity to SEQ ID NO:252 and 262, respectively; the V$_H$ region and the V$_L$ regions contain the amino acid sequence set forth in SEQ ID NOs:253 and 263, respectively, or a sequence of amino acids that has at least 90% identity to SEQ ID NO:253 and 263, respectively; the V$_H$ region and the V$_L$ regions contain the amino acid sequence set forth in SEQ ID NOs:254 and 264, respectively, or a sequence of amino acids that has at least 90% identity to SEQ ID NO:254 and 264, respectively; the V$_H$ region and the V$_L$ regions contain the amino acid sequence set forth in SEQ ID NOs:255 and 265, respectively, or a sequence of amino acids that has at least 90% identity to SEQ ID NO:255 and 265, respectively; the V$_H$ region and the V$_L$ regions contain the amino acid sequence set forth in SEQ ID NOs:256 and 266, respectively, or a sequence of amino acids that has at least 90% identity to SEQ ID NO:256 and 266, respectively; the V$_H$ region and the V$_L$ regions contain the amino acid sequence set forth in SEQ ID NOs:256 and 267, respectively, or a sequence of amino acids that has at least 90% identity to SEQ ID NO:256 and 267, respectively; the V$_H$ region and the V$_L$ regions contain the amino acid sequence set forth in SEQ ID NOs:518 and 534, respectively, or a sequence of amino acids that has at least 90% identity to SEQ ID NO:518 and 534, respectively; the V$_H$ region and the V$_L$ regions contain the amino acid sequence set forth in SEQ ID NOs:519 and 535, respectively, or a sequence of amino acids that has at least 90% identity to SEQ ID NO:519 and 535, respectively; the V$_H$ region and the V$_L$ regions contain the amino acid sequence set forth in SEQ ID NOs:115 and 536, respectively, or a sequence of amino acids that has at least 90% identity to SEQ ID NO:115 and 536, respectively; the V$_H$ region and the V$_L$ regions contain the amino acid sequence set forth in SEQ ID NOs:520 and 264, respectively, or a sequence of amino acids that has at least 90% identity to SEQ ID NO:520 and 264, respectively; the V$_H$ region and the V$_L$ regions contain the amino acid sequence set forth in SEQ ID NOs:521 and 537, respectively, or a sequence of amino acids that has at least 90% identity to SEQ ID NO:521 and 537, respectively; the V$_H$ region and the V$_L$ regions contain the amino acid sequence set forth in SEQ ID NOs:522 and 538, respectively, or a sequence of amino acids that has at least 90% identity to SEQ ID NO:522 and 538, respectively; the V$_H$ region and the V$_L$ regions contain the amino acid sequence set forth in SEQ ID NOs:523 and 539, respectively, or a sequence of amino acids that has at least 90% identity to SEQ ID NO:523 and 539, respectively; the V$_H$ region and the V$_L$ regions contain the amino acid sequence set forth in SEQ ID NOs:519 and 540, respectively, or a sequence of amino acids that has at least 90% identity to SEQ ID NO:519 and 540, respectively; the V$_H$ region and the V$_L$ regions contain the amino acid sequence set forth in SEQ ID NOs:524 and 541, respectively, or a sequence of amino acids that has at least 90% identity to SEQ ID NO:524 and 541, respectively; the V$_H$ region and the V$_L$ regions contain the amino acid sequence set forth in SEQ ID NOs:525 and 261, respectively, or a sequence of amino acids that has at least 90% identity to SEQ ID NO:525 and 261, respectively; the V$_H$ region and the V$_L$ regions contain the amino acid sequence set forth in SEQ ID NOs:526 and 542, respectively, or a sequence of amino acids that has at least 90% identity to SEQ ID NO:526 and 542, respectively; the V$_H$ region and the V$_L$ regions contain the amino acid sequence set forth in SEQ ID NOs:527 and 543, respectively, or a sequence of amino acids that has at least 90% identity to SEQ ID NO:527 and 543, respectively; the V$_H$ region and the V$_L$ regions contain the amino acid sequence set forth in SEQ ID NOs:528 and 544, respectively, or a sequence of amino acids that has at least 90% identity to SEQ ID NO:528 and 544, respectively; the V$_H$ region and the V$_L$ regions contain the amino acid sequence set forth in SEQ ID NOs:529 and 545, respectively, or a sequence of amino acids that has at least 90% identity to SEQ ID NO:529 and 545, respectively; the V$_H$ region and the V$_L$ regions contain the amino acid sequence set forth in SEQ ID NOs:528 and 546, respectively, or a sequence of amino acids that has at least 90% identity to SEQ ID NO:528 and 546, respectively; the $V_H$ region and the $V_L$ regions contain the amino acid sequence set forth in SEQ ID NOs:522 and 547, respectively, or a sequence of amino acids that has at least 90% identity to SEQ ID NO:522 and 547, respectively; the $V_H$ region and the $V_L$ regions contain the amino acid sequence set forth in SEQ ID NOs:256 and 548, respectively, or a sequence of amino acids that has at least 90% identity to SEQ ID NO:256 and 548, respectively; the $V_H$ region and the $V_L$ regions contain the amino acid sequence set forth in SEQ ID NOs:530 and 549, respectively, or a sequence of amino acids that has at least 90% identity to SEQ ID NO:530 and 549, respectively; the $V_H$ region and the $V_L$ regions contain the amino acid sequence set forth in SEQ ID NOs:531 and 550, respectively, or a sequence of amino acids that has at least 90% identity to SEQ ID NO:531 and 550, respectively; the $V_H$ region and the $V_L$ regions contain the amino acid sequence set forth in SEQ ID NOs:519 and 552, respectively, or a sequence of amino acids that has at least 90% identity to SEQ ID NO:519 and 552, respectively; the $V_H$ region and the $V_L$ regions contain the amino acid sequence set forth in SEQ ID NOs:110 and 553, respectively, or a sequence of amino acids that has at least 90% identity to SEQ ID NO:110 and 553, respectively; the $V_H$ region and the $V_L$ regions contain the amino acid sequence set forth in SEQ ID NOs:110 and 118, respectively, or a sequence of amino acids that has at least 90% identity to SEQ ID NO:110 and 118, respectively; the $V_H$ region and the $V_L$ regions contain the amino acid sequence set forth in SEQ ID NOs:533 and 554, respectively, or a sequence of amino acids that has at least 90% identity to SEQ ID NO:533 and 554, respectively; the $V_H$ region and the $V_L$ regions contain the amino acid sequence set forth in SEQ ID NOs:115 and 555, respectively, or a sequence of amino acids that has at least 90% identity to SEQ ID NO:115 and 555, respectively; the $V_H$ region and the $V_L$ regions contain the amino acid sequence set forth in SEQ ID NOs:524 and 556, respectively, or a sequence of amino acids that has at least 90% identity to SEQ ID NO:524 and 556, respectively; the $V_H$ region and the $V_L$ regions contain the amino acid sequence set forth in SEQ ID NOs:519 and 557, respectively, or a sequence of amino acids that has at least 90% identity to SEQ ID NO:519 and 557, respectively; the $V_H$ region and the $V_L$ regions contain the amino acid sequence set forth in SEQ ID NOs:609 and 610, respectively, or a sequence of amino acids that has at least 90% identity to SEQ ID NO:609 and 610, respectively; the $V_H$ region and the $V_L$ regions contain the amino acid sequence set forth in SEQ ID NOs:617 and 618, respectively, or a sequence of amino acids that has at least 90% identity to SEQ ID NO:617 and 618, respectively; the $V_H$ region and the $V_L$ regions contain the amino acid sequence set forth in SEQ ID NOs:324 and 326, respectively, or a sequence of amino acids that has at least 90% identity to SEQ ID NO:324 and 326, respectively; or the $V_H$ region and the $V_L$ regions contain the amino acid sequence set forth in SEQ ID NOs:325 and 327, respectively, or a sequence of amino acids that has at least 90% identity to SEQ ID NO:325 and 327, respectively.

In some embodiments of any of the chimeric antigen receptors described herein, the $V_H$ region and the $V_L$ regions contain the amino acid sequence set forth in SEQ ID NOs:110 and 116, respectively, or a sequence of amino acids that has at least 90% identity to SEQ ID NO:110 and 116, respectively; the $V_H$ region and the $V_L$ regions contain the amino acid sequence set forth in SEQ ID NOs:111 and 117, respectively, or a sequence of amino acids that has at least 90% identity to SEQ ID NO:111 and 117, respectively; the $V_H$ region and the $V_L$ regions contain the amino acid sequence set forth in SEQ ID NOs:110 and 118, respectively, or a sequence of amino acids that has at least 90% identity to SEQ ID NO:110 and 118, respectively; the $V_H$ region and the $V_L$ regions contain the amino acid sequence set forth in SEQ ID NOs:110 and 120, respectively, or a sequence of amino acids that has at least 90% identity to SEQ ID NO:110 and 120, respectively; the $V_H$ region and the $V_L$ regions contain the amino acid sequence set forth in SEQ ID NOs:110 and 121, respectively, or a sequence of amino acids that has at least 90% identity to SEQ ID NO:110 and 121, respectively; the $V_H$ region and the $V_L$ regions contain the amino acid sequence set forth in SEQ ID NOs:112 and 124, respectively, or a sequence of amino acids that has at least 90% identity to SEQ ID NO:112 and 124, respectively; the $V_H$ region and the $V_L$ regions contain the amino acid sequence set forth in SEQ ID NOs:113 and 125, respectively, or a sequence of amino acids that has at least 90% identity to SEQ ID NO:113 and 125, respectively; the $V_H$ region and the $V_L$ regions contain the amino acid sequence set forth in SEQ ID NOs:248 and 258, respectively, or a sequence of amino acids that has at least 90% identity to SEQ ID NO:248 and 258, respectively; the $V_H$ region and the $V_L$ regions contain the amino acid sequence set forth in SEQ ID NOs:252 and 262, respectively, or a sequence of amino acids that has at least 90% identity to SEQ ID NO:252 and 262, respectively; the $V_H$ region and the $V_L$ regions contain the amino acid sequence set forth in SEQ ID NOs:253 and 263, respectively, or a sequence of amino acids that has at least 90% identity to SEQ ID NO:253 and 263, respectively; the $V_H$ region and the $V_L$ regions contain the amino acid sequence set forth in SEQ ID NOs:254 and 264, respectively, or a sequence of amino acids that has at least 90% identity to SEQ ID NO:254 and 264, respectively; the $V_H$ region and the $V_L$ regions contain the amino acid sequence set forth in SEQ ID NOs:255 and 265, respectively, or a sequence of amino acids that has at least 90% identity to SEQ ID NO:255 and 265, respectively; the $V_H$ region and the $V_L$ regions contain the amino acid sequence set forth in SEQ ID NOs:256 and 266, respectively, or a sequence of amino acids that has at least 90% identity to SEQ ID NO:256 and 266, respectively; the $V_H$ region and the $V_L$ regions contain the amino acid sequence set forth in SEQ ID NOs:256 and 267, respectively, or a sequence of amino acids that has at least 90% identity to SEQ ID NO:256 and 267, respectively; the $V_H$ region and the $V_L$ regions contain the amino acid sequence set forth in SEQ ID NOs:518 and 534, respectively, or a sequence of amino acids that has at least 90% identity to SEQ ID NO:518 and 534, respectively; the $V_H$ region and the $V_L$ regions contain the amino acid sequence set forth in SEQ ID NOs:519 and 535, respectively, or a sequence of amino acids that has at least 90% identity to SEQ ID NO:519 and 535, respectively; the $V_H$ region and the $V_L$ regions contain the amino acid sequence set forth in SEQ ID NOs:115 and 536, respectively, or a sequence of amino acids that has at least 90% identity to SEQ ID NO:115 and 536, respectively; the $V_H$ region and the $V_L$ regions contain the amino acid sequence set forth in SEQ ID NOs:520 and 264, respectively, or a sequence of amino acids that has at least 90% identity to SEQ ID NO:520 and 264, respectively; the $V_H$ region and the $V_L$ regions contain the amino acid sequence set forth in SEQ ID NOs:521 and 537, respectively, or a sequence of amino acids that has at least 90% identity to SEQ ID NO:521 and 537, respectively; the $V_H$ region and the $V_L$ regions contain the amino acid sequence set forth in SEQ ID NOs:522 and 538, respectively, or a sequence of amino acids that has at least 90% identity to SEQ ID NO:522 and 538, respectively; the V$_H$ region and the V$_L$ regions contain the amino acid sequence set forth in SEQ ID NOs:609 and 610, respectively, or a sequence of amino acids that has at least 90% identity to SEQ ID NO:609 and 610, respectively; the V$_H$ region and the V$_L$ regions contain the amino acid sequence set forth in SEQ ID NOs:617 and 618, respectively, or a sequence of amino acids that has at least 90% identity to SEQ ID NO:617 and 618, respectively; the V$_H$ region and the V$_L$ regions contain the amino acid sequence set forth in SEQ ID NOs:324 and 326, respectively, or a sequence of amino acids that has at least 90% identity to SEQ ID NO:324 and 326, respectively; or the V$_H$ region and the V$_L$ regions contain the amino acid sequence set forth in SEQ ID NOs:325 and 327, respectively, or a sequence of amino acids that has at least 90% identity to SEQ ID NO:325 and 327, respectively.

In some embodiments of any of the chimeric antigen receptors described herein, the fragment includes an scFv. In some embodiments, the V$_H$ region and the V$_L$ region are joined by a flexible linker. In some embodiments, the scFv includes a linker containing the amino acid sequence GGGGSGGGGSGGGGS (SEQ ID NO: 361). In some embodiments, the V$_H$ region is amino-terminal to the V$_L$ region.

In some embodiments of any of the chimeric antigen receptors described herein, the antigen-binding domain includes the amino acid sequence selected from any one of SEQ ID NOs:128-139, 268-278, 329, 442, 478, 558-576, 578-583, 585, or 769-771 or an amino acid sequence having at least 90%, 91%, 92%, 93%, 94%, 95%, 96%, 97%, 98%, or 99% sequence identity to the amino acid sequence selected from any one of SEQ ID NOs: 128-139, 268-278, 329, 442, 478, 558-576, 578-583, 585, or 769-771. In some embodiments, the antigen-binding domain includes the amino acid sequence selected from any one of SEQ ID NOs:128-130, 132, 133, 136, 137, 269, 273-278, 329, 442, 478, 558-563 or 585 or an amino acid sequence having at least 90%, 91%, 92%, 93%, 94%, 95%, 96%, 97%, 98%, or 99% sequence identity to the amino acid sequence selected from any one of SEQ ID NOs: 128-130, 132, 133, 136, 137, 269, 273-278, 329, 442, 478, 558-563 or 585.

In some embodiments of any of the chimeric antigen receptors described herein, the V$_H$ region is carboxy-terminal to the V$_L$ region. In some embodiments, the scFv includes the amino acid sequence set forth in SEQ ID NOs: 328 or 586, or an amino acid sequence having at least 90%, 91%, 92%, 93%, 94%, 95%, 96%, 97%, 98%, or 99% sequence identity to the amino acid sequence set forth in SEQ ID NO: 328 or 586.

In some embodiments of any of the chimeric antigen receptors described herein, the intracellular signaling region includes an activating cytoplasmic signaling domain. In some embodiments of any of the chimeric antigen receptors described herein, the activating cytoplasmic signaling domain is capable of inducing a primary activation signal in a T cell, is a T cell receptor (TCR) component and/or includes an immunoreceptor tyrosine-based activation motif (ITAM). In some embodiments, the activating cytoplasmic signaling domain is or includes a cytoplasmic signaling domain of a zeta chain of a CD3-zeta (CD3ζ) chain or a functional variant or signaling portion thereof. In some embodiments, the activating cytoplasmic domain is human or is derived from a human protein. In some embodiments, the activating cytoplasmic domain is or includes the sequence set forth in SEQ ID NO:628 or a sequence of amino acids that has at least 90% sequence identity to SEQ ID NO:628.

In some embodiments of any of the chimeric antigen receptors described herein, the intracellular signaling region further includes a costimulatory signaling region. In some embodiments, the costimulatory signaling region includes an intracellular signaling domain of a T cell costimulatory molecule or a signaling portion thereof. In some embodiments, the costimulatory signaling region includes an intracellular signaling domain of a CD28, a 4-1BB or an ICOS or a signaling portion thereof. In some embodiments, the costimulatory signaling region includes an intracellular signaling domain of 4-1BB. In some embodiments, the costimulatory signaling region is human or is derived from a human protein. In some embodiments, the costimulatory signaling region is or includes the sequence set forth in SEQ ID NO:626 or a sequence of amino acids that exhibits at least 90% sequence identity to the sequence set forth in SEQ ID NO: 626. In some embodiments, the costimulatory signaling region is between the transmembrane domain and the intracellular signaling region. In some embodiments, the transmembrane domain is or includes a transmembrane domain derived from CD4, CD28, or CD8. In some embodiments, the transmembrane domain is or includes a transmembrane domain derived from a CD28. In some embodiments, the transmembrane domain is human or is derived from a human protein. In some embodiments of any of the chimeric antigen receptors described herein, the transmembrane domain is or includes the sequence set forth in SEQ ID NO:624 or a sequence of amino acids that exhibits at least 90% sequence identity to SEQ ID NO:624.

In some embodiments of any of the chimeric antigen receptors described herein, the encoded chimeric antigen receptor includes from its N to C terminus in order: the antigen-binding domain, the spacer, the transmembrane domain and the intracellular signaling domain.

In some of any of the embodiments, the chimeric antigen receptor is encoded by a polynucleotide sequence comprising the sequence set forth in any of SEQ ID NOS: 751-756 or a sequence that exhibits at least 85%, 86%, 87%, 88%, 89%, 90%, 91%, 92%, 93%, 94%, 95%, 96%, 97%, 98%, or 99% sequence identity to the sequence set forth in any of SEQ ID NOS: 751-756. In some of any of the embodiments, the chimeric antigen receptor is encoded by a polynucleotide sequence comprising the sequence set forth in any of SEQ ID NOS: 755 and 756 or a sequence that exhibits at least 85%, 86%, 87%, 88%, 89%, 90%, 91%, 92%, 93%, 94%, 95%, 96%, 97%, 98%, or 99% sequence identity to the sequence set forth in any of SEQ ID NOS: 755 and 756. In some of any of the embodiments, the chimeric antigen receptor is encoded by a polynucleotide sequence comprising the sequence set forth in SEQ ID NO: 755 or a sequence that exhibits at least 85%, 86%, 87%, 88%, 89%, 90%, 91%, 92%, 93%, 94%, 95%, 96%, 97%, 98%, or 99% sequence identity thereto. In some of any of the embodiments, the chimeric antigen receptor is encoded by a polynucleotide sequence comprising the sequence set forth in SEQ ID NO: 755.

Provided in some embodiments are engineered cells that contain a polynucleotide of any of the embodiments described herein. In some embodiments of any of the engineered cells described herein, the engineered cell contains the chimeric antigen receptor of any of the embodiments described herein.

In some embodiments of any of the engineered cells described herein, the cell is an immune cell. In some embodiments, the immune cell is a primary cell obtained from a subject. In some embodiments, the immune cell is an NK cell or a T cell. In some embodiments, the immune cell is a T cell and the T cell is a CD4+ and/or CD8+ T cell.

In some embodiments of any of the engineered cells described herein, the cell contains transcribed RNA encoding the chimeric antigen receptor, optionally messenger RNA (mRNA), that exhibits at least 70%, 75%, 80%, 85%, 90%, or 95% RNA homogeneity. In some embodiments, the cell contains transcribed RNA encoding the chimeric antigen receptor, optionally messenger RNA (mRNA), that exhibits reduced heterogeneity compared to the heterogeneity of transcribed mRNA in a cell encoding a reference chimeric antigen receptor, said reference chimeric antigen receptor containing the same amino acid sequence as the chimeric antigen receptor but encoded by a different polynucleotide sequence containing one or more nucleotide differences in the polynucleotide encoding the CARs and/or in which the reference chimeric antigen receptor is encoded by a polynucleotide containing one or more splice donor site and/or one or more splice acceptor site in the nucleic acid encoding the spacer. In some embodiments, the RNA heterogeneity is reduced by greater than or greater than about 10%, 15%, 20%, 25%, 30%, 40%, 50% or more. In some embodiments, the cell encoding the reference CAR includes transcribed RNA encoding the reference CAR, optionally messenger RNA (mRNA), that exhibits greater than or greater than about 10%, 15%, 20%, 25%, 30%, 40%, 50% or more RNA heterogeneity. In some embodiments, the RNA homogeneity and/or heterogeneity is determined by agarose gel electrophoresis, chip-based capillary electrophoresis, analytical ultracentrifugation, field flow fractionation, or liquid chromatography.

In some embodiments of any of the engineered cells described herein, among a plurality of the engineered cells, less than or less than about 10%, 9%, 8%, 7%, 5%, 4%, 3%, 2% or 1% of the cells in the plurality contain a chimeric antigen receptor that exhibits tonic signaling and/or antigen independent activity or signaling.

Also provided are compositions comprising any of the engineered cells provided herein. In some of any such embodiments, the composition comprises CD4+ and CD8+ T cells and the ratio of CD4+ to CD8+ T cells is from or from about 1:3 to 3:1.

Also provided herein are compositions containing a polynucleotide of any of the embodiments described herein, a chimeric antigen receptor of any of the embodiments described herein, or a engineered cell of any of the embodiments described herein. In some embodiments, the composition further contains a pharmaceutically acceptable excipient. In some of any of these embodiments, the composition is sterile.

Provided in other aspects are methods of treatment that involve administering the engineered cells of any of the embodiments described herein or the composition of any of the embodiments described herein to a subject having a disease or disorder. In some of any embodiments, the method comprises administering a dose of the engineered cells or a composition comprising a dose of the engineered cells.

Also provided are uses any of the engineered cells or the compositions described herein for the manufacture of a medicament for the treatment of a disease or disorder. Also provided are uses any of the engineered cells or the compositions described herein for treating a disease or disorder. In some of any such embodiments, the engineered cells or the composition are for use in a treatment regimen, wherein the treatment regimen comprises administering a dose of the engineered cells or a composition comprising a dose of the engineered cells.

In some embodiments of any of the methods described herein, the disease or disorder is associated with expression of B cell maturation antigen (BCMA). In some embodiments, the disease or disorder associated with BCMA is a B cell-related disorder. In some embodiments, the disease or disorder associated with BCMA is an autoimmune disease or disorder. In some embodiments, the autoimmune disease or disorder is systemic lupus erythematosus (SLE), lupus nephritis, inflammatory bowel disease, rheumatoid arthritis, ANCA associated vasculitis, idiopathic thrombocytopenia purpura (ITP), thrombotic thrombocytopenia purpura (TTP), autoimmune thrombocytopenia, Chagas' disease, Grave's disease, Wegener's granulomatosis, poly-arteritis nodosa, Sjogren's syndrome, pemphigus vulgaris, scleroderma, multiple sclerosis, psoriasis, IgA nephropathy, IgM polyneuropathies, vasculitis, diabetes mellitus, Reynaud's syndrome, anti-phospholipid syndrome, Goodpasture's disease, Kawasaki disease, autoimmune hemolytic anemia, myasthenia gravis, or progressive glomerulonephritis.

In some embodiments of any of the methods described herein, the disease or disorder associated with BCMA is a cancer. In some embodiments, the cancer is a BCMA-expressing cancer. In some embodiments, the cancer is a B cell malignancy. In some embodiments, the cancer is a lymphoma, a leukemia, or a plasma cell malignancy. In some embodiments, the cancer is a lymphoma and the lymphoma is Burkitt's lymphoma, non-Hodgkin's lymphoma (NHL), Hodgkin's lymphoma, Waldenstrom macroglobulinemia, follicular lymphoma, small non-cleaved cell lymphoma, mucosa-associated lymphatic tissue lymphoma (MALT), marginal zone lymphoma, splenic lymphoma, nodal monocytoid B cell lymphoma, immunoblastic lymphoma, large cell lymphoma, diffuse mixed cell lymphoma, pulmonary B cell angiocentric lymphoma, small lymphocytic lymphoma, primary mediastinal B cell lymphoma, lymphoplasmacytic lymphoma (LPL), or mantle cell lymphoma (MCL). In some embodiments, the cancer is a leukemia and the leukemia is chronic lymphocytic leukemia (CLL), plasma cell leukemia or acute lymphocytic leukemia (ALL). In some embodiments, the cancer is a plasma cell malignancy and the plasma cell malignancy is multiple myeloma (MM) or plasmacytoma. In some embodiments, the cancer is multiple myeloma (MM).

In some of any embodiments, the dose of engineered T cells comprises between at or about $1 \times 10^7$ CAR-expressing T cells and at or about $2 \times 10^9$ CAR-expressing T cells. In some of any embodiments, the dose of engineered T cells comprise between at or about $2.5 \times 10^7$ CAR-expressing T cells and at or about $1.2 \times 10^9$ CAR-expressing T cells, between at or about $5.0 \times 10^7$ CAR-expressing T cells and at or about $4.5 \times 10^8$ CAR-expressing T cells, or between at or about $1.5 \times 10^8$ CAR-expressing T cells and at or about $3.0 \times 10^8$ CAR-expressing T cells. In some of any embodiments, the dose of engineered T cells comprise at or about $2.5 \times 10^7$, at or about $5.0 \times 10^7$, at or about $1.5 \times 10^8$, at or about $3.0 \times 10^8$, at or about $4.5 \times 10^8$, at or about $8.0 \times 10^8$ or at or about $1.2 \times 10^9$ CAR-expressing T cells. In some of any embodiments, the dose of engineered T cells comprise at or about $5.0 \times 10^7$, at or about $1.5 \times 10^8$, at or about $3.0 \times 10^8$ or at or about $4.5 \times 10^8$ CAR-expressing T cells. In some of any embodiments, the dose of engineered T cells comprises a combination of CD4$^+$ T cells and CD8$^+$ T cells, at a defined ratio of CD4$^+$ CAR-expressing T cells to CD8$^+$ CAR-expressing T cells and/or of CD4+ T cells to CD8+ T cells, that is or is approximately 1:1 or is between approximately 1:3 and approximately 3:1.

In some of any embodiments, less than about 25%, 20%, 15%, 10%, 9%, 8%, 7%, 6%, 5%, 4%, 3%, 2% or 1% of the CAR-expressing T cells in the dose of engineered T cells express a marker of apoptosis, optionally Annexin V or active Caspase 3. In some of any embodiments, less than 5%, 4%, 3%, 2% or 1% of the CAR-expressing T cells in the dose of engineered T cells express Annexin V or active Caspase 3.

In some of any embodiments, prior to the administration, the subject has received a lymphodepleting therapy comprising the administration of fludarabine at or about 20-40 mg/m$^2$ body surface area of the subject, optionally at or about 30 mg/m$^2$, daily, for 2-4 days, and/or cyclophosphamide at or about 200-400 mg/m$^2$ body surface area of the subject, optionally at or about 300 mg/m$^2$, daily, for 2-4 days.

In some of any embodiments, the subject has received a lymphodepleting therapy comprising the administration of fludarabine at or about 30 mg/m$^2$ body surface area of the subject, daily, and cyclophosphamide at or about 300 mg/m$^2$ body surface area of the subject, daily, for 3 days.

In some of any embodiments, at or prior to the administration of the dose of cells, the subject has received three or more therapies selected from among: autologous stem cell transplant (ASCT); an immunomodulatory agent; a proteasome inhibitor; and an anti-CD38 antibody.

In some of any embodiments, the immunomodulatory agent is selected from among thalidomide, lenalidomide or pomalidomide. In some of any embodiments, the proteasome inhibitor is selected from among bortezomib, carfilzomib or ixazomib. In some of any embodiments, the anti-CD38 antibody is or comprises daratumumab.

In some of any embodiments, at the administration of the dose of cells, the subject has not had active or history of plasma cell leukemia (PCL).

In some of any embodiments, when administered to subjects, the dose or the composition is capable of achieving objective response (OR), in at least 50%, 60%, 70%, 80%, 90%, or 95% of subjects that were administered. In some of any embodiments, the OR includes subjects who achieve stringent complete response (sCR), complete response (CR), very good partial response (VGPR), partial response (PR) and minimal response (MR). In some of any embodiments, when administered to subjects, the dose or the composition is capable of achieving stringent complete response (sCR), complete response (CR), very good partial response (VGPR) or partial response (PR), in at least 50%, 60%, 70%, 80%, or 85% of subjects that were administered. In some of any embodiments, when administered to subjects, the dose or the composition is capable of achieving stringent complete response (sCR) or complete response (CR) at least 20%, 30%, 40% 50%, 60% or 70% of subjects that were administered.

In some of any embodiments, the dose of engineered T cells comprise at or about 5.0×10$^7$, at or about 1.5×10$^8$, at or about 3.0×10$^8$ or at or about 4.5×10$^8$ CAR-expressing T cells. In some of any embodiments, the dose of the engineered T cells comprise at or about 5.0×10$^7$ CAR-expressing T cells.

Also provided herein are methods of determining the heterogeneity of a transcribed nucleic acid of a transgene, the method comprising: a) amplifying a transcribed nucleic acid using at least one 5' and 3' primer pair, wherein at least one pair comprises a 5' primer that is complementary to a nucleic acid sequence within the 5' untranslated region (5' UTR) of the transcribed nucleic acid and a 3' primer that is complementary to a nucleic acid sequence within the 3' untranslated region (3' UTR) of the transcribed nucleic acid to generate one or more amplified products; and b) detecting the amplified products, wherein the presence of two or more amplified products from at least one 5' and 3' primer pair indicates heterogeneity in the amplified products.

In some embodiments of the method, the detected differences in b) are different lengths of the amplified transcripts. In some embodiments, the differences in b) are differences in chromatographic profiles of the amplified transcripts.

In some embodiments, the differences in the amplified products are determined by agarose gel electrophoresis, chip-based capillary electrophoresis, analytical ultracentrifugation, field flow fractionation, or chromatography. In some embodiments, the 5' primer is specific to sequence transcribed from the promoter region of the transcribed nucleic acid. In some embodiments, the transcribed nucleic acid is amplified using a 3' primer specific to a sequence within the amino acid-coding sequence of the polynucleotide, and/or the 3' untranslated region, on of the transcribed pre-mRNA. In some embodiments, the 3 primer is specific to the polyadenylation sequence or enhancer region of the 3' untranslated region of the transcribed pre-mRNA.

In some embodiments, step a) is effected by a single amplification reaction, using a single 5' and 3' primer pair comprising a 5' primer that is complementary to a nucleic acid sequence within the 5' untranslated region (5' UTR) of the transcribed nucleic acid and a 3' primer that is complementary to a nucleic acid sequence within the 3' untranslated region (3' UTR). In some embodiments, step a) is effected by parallel or subsequent amplification reactions using a first 5' and 3' primer pair, a second 5' and 3'primer pair, and optionally additional 5' and 3'primer pairs, wherein: the first 5' and 3'primer pair contains a 5' primer that is complementary to a nucleic acid sequence within the 5' UTR of the transcribed nucleic acid and a 3' primer that is complementary to a nucleic acid sequence within the 3' UTR of the transcribed nucleic acid; the second 5' and 3' primer pair contains a 5' primer whose sequence is complementary to a portion of the translated sequence of the nucleic acid transcript and a 3' primer whose sequence is complementary to a nucleic acid sequence within the 3' UTR of the transcript; and the optionally additional 5' and 3'primer pairs each contain sequences complementary to sequences within the translated region of the transcript. In some embodiments, the parallel or subsequent amplification reactions amplify overlapping portions of the transcript.

In some embodiments, the amplified products are predicted to be about 1.5 kilobases, 2 kilobases, 2.5 kilobases, 3 kilobases, 3.5 kilobases, 4 kilobases, 4.5 kilobases, 5 kilobases, 5.5 kilobases, 6 kilobases, 7 kilobases, or 8 kilobases in length.

In some of any embodiments, a transcribed nucleic acid that is detected as having heterogeneity is identified as a transgene candidate for removal of one or more splice site. In some of any embodiments, the transcribed nucleic acid of the transgene candidate exhibits at least or at least about 5%, 10%, 15%, 20%, 25%, 30%, 40%, 45%, 50%, 55%, 60%, 65%, 70%, 75% or more heterogeneity following expression in a cell.

Also provided are methods of reducing the heterogeneity of an expressed transgene transcript, the method comprising: a) identifying a transgene candidate for the removal of splice sites according to any of the methods for determining the heterogeneity of a transcribed nucleic acid provided herein;

b) identifying one or more potential splice donor and/or splice acceptor sites; and c) modifying the nucleic acid sequence at or near the one or more potential splice donor and/or splice acceptor sites identified in b), thereby generating a modified polynucleotide.

In some of any such embodiments, the method also involves d) assessing the transgene candidacy for the removal of splice sites as in step a). In some of any such embodiments, the method also involves e) repeating steps b)-d) until the heterogeneity of the transcript in step d) is reduced compared to the heterogeneity of the transcript as determined in step a).

In some of any such embodiments, the one or more potential splice donor and/or splice acceptor sites exhibit a score about or at least about 0.7, 0.75, 0.8, 0.85, 0.9, 0.95, or 1.0 of a splice event, and/or is/are predicted to be involved in a splice event with a probability of at least 70%, 75%, 80%, 85%, 90%, 95%, 99%, or 100%.

In some of any such embodiments, splice donor sites and splice acceptor sites are identified independently. In some of any such embodiments, the splice acceptor and/or donor site(s) is/are canonical, non-canonical, and/or cryptic splice acceptor and/or donor site(s).

In some of any such embodiments, the transgene is a chimeric antigen receptor or a portion of a chimeric antigen receptor. In some of any such embodiments, the CAR polypeptide comprises an antigen-binding domain comprising an antibody fragment, optionally a single chain antibody fragment (scFv), comprising a variable heavy chain ($V_H$) and a variable light chain ($V_L$), a spacer (e.g., a spacer region located between the ligand-binding domain and the transmembrane domain, of the recombinant receptor), a transmembrane region, and an intracellular signaling region.

In some of any such embodiments, the modified polynucleotide is not modified within the coding sequence for the antigen-binding domain of the encoded CAR polypeptide. In some of any such embodiments, the encoded amino acid sequence of the transgene is unchanged following modification of the polynucleotide. In some of any such embodiments, the RNA transcribed from the modified polynucleotide exhibits at least or at least about 70%, 75%, 80%, 85%, 90%, or 95% homogeneity following expression of the unmodified polynucleotide in a cell.

In some of any such embodiments, the cell is a human cell. In some of any such embodiments, the cell is a T-cell.

In some of any such embodiments, the method is a computer implemented method, and wherein one or more steps a)-c) occur at an electronic device comprising one or more processors and memory.

Also provided are computer systems comprising a processor and memory, the memory comprising instructions operable to cause the processor to carry out any one or more of steps of the methods of reducing the heterogeneity of an expressed transgene transcript.

BRIEF DESCRIPTION OF THE DRAWINGS

FIG. 1A depicts the RNA heterogeneity of several anti-BCMA-CARs, containing a long spacer (LS) region, or a shorter CD28 spacer region. FIG. 1B depicts RNA heterogeneity of three different anti-BCMA CAR encoding sequences, containing the long spacer (LS) region, before and after coding sequence optimization and splice site elimination (O/SSE).

FIG. 4A depicts results of an assay assessing the cytolytic activity of BMCA-LS CAR-expressing T cells against cell lines that express high (K562/BCMA) or low (RPMI 8226) levels of BCMA at several effector:target cell (E:T) ratios.

FIG. 16A depicts results of an assay assessing expression level of tdTomato and a truncated receptor (surrogate marker for CAR expression), as detected by flow cytometry, in BCMA-55-LS-O/SSE CAR-expressing cells, incubated for 6 hours in 96-well cell culture plates coated overnight with (0.008 µg/mL, 0.04 µg/mL, 0.2 µg/mL, 1 µg/mL and 5 µg/mL) of BCMA-Fc (soluble human BCMA fused at its C-terminus to an Fc region of IgG) fusion polypeptide. A recombinant Fc polypeptide was used as a control (Fc Control).

FIG. 17 depicts the percentage of tdTomato+ cells among reporter cells expressing BCMA-55-LS-O/SSE CAR or BCMA-55-SS CAR, following co-cultured with human BCMA-expressing K562 target cells (BCMA.K562) target cells at various E:T ratios.

FIGS. 19A and 19B depict the expression level of tdTomato and truncated receptor (surrogate marker for CAR expression), as detected by flow cytometry, in reporter cells expressing an anti-CD19 CAR, BCMA-55-LS-O/SSE CAR, BCMA-26-LS-O/SSE CAR, BCMA-23-LS-O/SSE CAR, or BCMA-52-LS-O/SSE CAR that contain intracellular domains derived from 4-1BB or CD28 incubated without antigen stimulation to assess the degree of antigen-independent (tonic) signaling.

FIG. 20A depicts the percentage of tdTomato+ cells, as assessed by flow cytometry, among the Nur77-tdTomato reporter cells engineered to express BCMA-55-LS-O/SSE CAR, specific for human BCMA, co-cultured with K562 human myelogenous leukemia cells expressing human BCMA (huBCMA), murine BCMA (muBCMA) or cynomolgus monkey BCMA (cynoBCMA), at an E:T ratio of 2:1 or 5:1. FIG. 20C) of tdTomato+ cells, as assessed by flow cytometry, among reporter cells expressing BCMA-55-LS-O/SSE CAR, incubated with increasing concentrations (0, 0.1, 0.25, 1, 2.5, 10, 25 and 100 µg/mL) of huBCMA and cynoBCMA coated on 96-well flat-bottom plates.

DETAILED DESCRIPTION

Figure 1A:
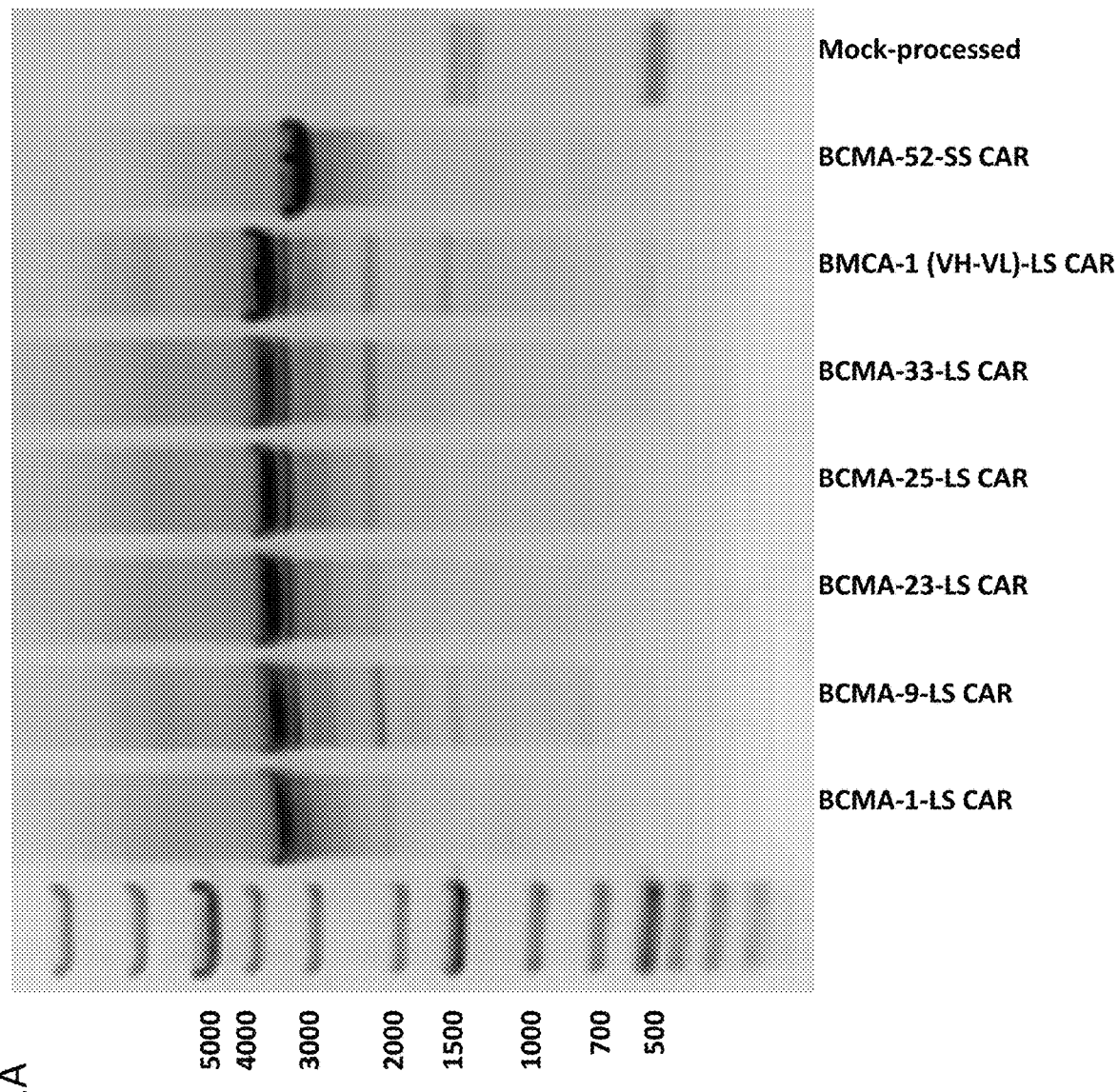
FIGS. 1A and 1B depict results of an assay assessing RNA heterogeneity as assessed by agarose gel electrophoresis.

Among the provided embodiments are compositions, articles of manufacture, compounds, methods and uses including those targeting or directed to BCMA and BCMA-expressing cells and diseases. It is observed that BCMA is expressed, e.g., heterogeneously expressed, on certain diseases and conditions such as malignancies or tissues or cells thereof, e.g., on malignant plasma cells such as from all relapsed or newly diagnosed myeloma patients, for example, with little expression on normal tissues. Among the provided embodiments are approaches useful in the treatment of such diseases and conditions and/or for targeting such cell types, including nucleic acid molecules that encode BCMA-binding receptors, including chimeric antigen receptors (CARs), and the encoded receptors such as the encoded CARs, and compositions and articles of manufacture comprising the same. The receptors generally can contain antibodies (including antigen-binding antibody fragments, such as heavy chain variable ($V_H$) regions, single domain antibody fragments and single chain fragments, including scFvs) specific for BCMA. Also provided are cells, such as engineered or recombinant cells expressing such BCMA-binding receptors, e.g., anti-BCMA CARs and/or containing nucleic acids encoding such receptors, and compositions and articles of manufacture and therapeutic doses containing such cells. Also provided are methods of evaluating, optimizing, making and using nucleic acid sequence(s), for example, nucleic acid sequences encoding recombinant BCMA-binding receptors. Also provided are methods of making and using (such as in the treatment or amelioration of BCMA-expressing diseases and conditions) cells (e.g., engineered cells) expressing or containing the recombinant BCMA-binding receptors and recombinant BCMA-binding receptor-encoding polynucleotides or compositions containing such cells.

Adoptive cell therapies (including those involving the administration of cells expressing chimeric receptors specific for a disease or disorder of interest, such as chimeric antigen receptors (CARs) and/or other recombinant antigen receptors, as well as other adoptive immune cell and adoptive T cell therapies) can be effective in the treatment of cancer and other diseases and disorders. In certain contexts, available approaches to adoptive cell therapy may not always be entirely satisfactory. In some aspects, the ability of the administered cells to recognize and bind to a target, e.g., target antigen such as BCMA, to traffic, localize to and successfully enter appropriate sites within the subject, tumors, and environments thereof, to become activated, expand, to exert various effector functions, including cytotoxic killing and secretion of various factors such as cytokines, to persist, including long-term, to differentiate, transition or engage in reprogramming into certain phenotypic states to provide effective and robust recall responses following clearance and re-exposure to target ligand or antigen, and avoid or reduce exhaustion, anergy, terminal differentiation, and/or differentiation into a suppressive state.

In some contexts, optimal response to therapy can depend on the ability of the engineered recombinant receptors such as CARs, to be consistently and reliably expressed on the surface of the cells and/or bind the target antigen. For example, in some cases, heterogeneity of the transcribed RNA from an introduced transgene (e.g., encoding the recombinant receptor) can affect the expression and/or activity of the recombinant receptor, in some cases when expressed in a cell, such as a human T cell, used in cell therapy. In some contexts, the length and type of spacer in the recombinant receptor, such as a CAR, can affect the expression, activity and/or function of the receptor.

Also, in some contexts, certain recombinant receptors can exhibit antigen-independent activity or signaling (also known as "tonic signaling"), which could lead to undesirable effects, such as due to increased differentiation and/or exhaustion of T cells that express the recombinant receptor. In some aspects, such activities may limit the T cell's activity, effect or potency. In some cases, during engineering and ex vivo expansion of the cells for recombinant receptor expression, the cells may exhibit phenotypes indicative of exhaustion, due to tonic signaling through the recombinant receptor.

In some contexts, properties of particular target antigens that the recombinant receptors specifically bind, recognize or target, can that affect the activity of the receptor. In some contexts, B-cell maturation antigen (BCMA), is typically expressed on malignant plasma cells and is an attractive therapeutic target for cell therapy. In some cases, BCMA is can be cleaved by gamma secretase, generating a soluble BCMA (sBCMA), or "shed" form of BCMA, reducing the BCMA expressed on the surface of target cells. In some cases, the activity of the BCMA-binding molecules, such as anti-BCMA chimeric antigen receptors, can be blocked or inhibited by the presence of soluble BCMA. Improved strategies are needed for optimal responses to cell therapies, in particular, for recombinant receptors that specifically bind, recognize or target BCMA.

The provided embodiments, in some contexts, are based on the observation that particular spacers and optimization of the nucleic acid sequences can lead to consistent and robust expression of the recombinant receptor. The provided BCMA-binding recombinant receptors offer advantages over available approaches for cell therapies, in particular, BCMA-targeting cell therapy. In some embodiments, provided BCMA-binding recombinant receptors are observed to exhibit reduced antigen-independent, tonic signaling and lack of inhibition by soluble BCMA. In various aspects, the provided BCMA-binding recombinant receptors, polynucleotides encoding such receptors, engineered cells and cell compositions, exhibit certain desired properties that can overcome or counteract certain limitations that can reduce optimal responses to cell therapy, for example, cell therapy with engineered cells expressing a BCMA-binding recombinant receptor. In some aspects, compositions containing engineered cells expressing an exemplary BCMA-binding recombinant receptor provided herein was observed to exhibit consistency of cell health of the engineered cells, and was associated with clinical response. In some contexts, the provided embodiments, including the recombinant receptors, polynucleotides encoding such receptors, engineered cells and cell compositions, can provide various advantages over available therapies targeting BCMA, to improve the activity of the recombinant receptors and response to BCMA-targeting cell therapies.

I. BCMA-BINDING RECEPTORS AND ENCODING POLYNUCLEOTIDES

Provided in some aspects are BCMA-binding agents, such as cell surface proteins, such as recombinant receptors or chimeric antigen receptors that bind or recognize BCMA molecules and polynucleotides encoding BCMA-binding cell surface proteins, such as recombinant receptors (e.g., CARs), and cells expressing such receptors. The BCMA-binding cell surface proteins generally contain antibodies (e.g., antigen-binding antibody fragments), and/or other binding peptides that specifically recognize, such as specifically bind to BCMA, such as to BCMA proteins, such as human BCMA protein. In some aspects, the agents bind to an extracellular portion of BCMA.

In some embodiments, the polynucleotides are optimized, or contain certain features designed for optimization, such as for codon usage, to reduce RNA heterogeneity and/or to modify, e.g., increase or render more consistent among cell product lots, expression, such as surface expression, of the encoded receptor. In some embodiments, polynucleotides, encoding BCMA-binding cell surface proteins, are modified as compared to a reference polynucleotide, such as to remove cryptic or hidden splice sites, to reduce RNA heterogeneity. In some embodiments, polynucleotides, encoding BCMA-binding cell surface proteins, are codon optimized, such as for expression in a mammalian, e.g., human, cell such as in a human T cell. In some aspects, the modified polynucleotides result in in improved, e.g., increased or more uniform or more consistent level of, expression, e.g., surface expression, when expressed in a cell. Such polynucleotides can be utilized in constructs for generation of engineered cells that express the encoded BCMA-binding cell surface protein. Thus, also provided are cells expressing the recombinant receptors encoded by the polynucleotides provided herein and uses thereof in adoptive cell therapy, such as treatment of diseases and disorders associated with BCMA expression.

Among the provided polynucleotides are those that encode recombinant receptors, such as antigen receptors, that specifically recognize, such as specifically bind, BCMA. In some aspects, the encoded receptors, such as those containing BCMA-binding polypeptides, and compositions and articles of manufacture and uses of the same, also are provided.

Among the BCMA-binding polypeptides are antibodies, such as single-chain antibodies (e.g., antigen binding antibody fragments), or portions thereof. In some examples, the recombinant receptors are chimeric antigen receptors, such as those containing anti-BCMA antibodies or antigen-binding fragments thereof. In any of the embodiments, an antibody or antigen binding fragment, in the provided CARs, that specifically recognizes an antigen, e.g. BCMA, specifically binds to the antigen. The provided polynucleotides can be incorporated into constructs, such as deoxyribonucleic acid (DNA) or RNA constructs, such as those that can be introduced into cells for expression of the encoded recombinant BCMA-binding receptors.

In some cases, the polynucleotide encoding the BCMA-binding receptor contains a signal sequence that encodes a signal peptide, in some cases encoded upstream of the nucleic acid sequences encoding the BCMA-binding receptor, or joined at the 5' terminus of the nucleic acid sequences encoding the antigen-binding domain. In some cases, the polynucleotide containing nucleic acid sequences encoding the BCMA-binding receptor, e.g., chimeric antigen receptor (CAR), contains a signal sequence that encodes a signal peptide. In some aspects, the signal sequence may encode a signal peptide derived from a native polypeptide. In other aspects, the signal sequence may encode a heterologous or non-native signal peptide. In some aspects, non-limiting exemplary signal peptide include a signal peptide of the IgG kappa chain set forth in SEQ ID NO: 620, or encoded by the nucleotide sequence set forth in SEQ ID NO: 619 or 682-685; a GMCSFR alpha chain set forth in SEQ ID NO:851 and encoded by the nucleotide sequence set forth in SEQ ID NO:850; a CD8 alpha signal peptide set forth in SEQ ID NO:852; or a CD33 signal peptide set forth in SEQ ID NO:853. In some cases, the polynucleotide encoding the BCMA-binding receptor can contain nucleic acid sequence encoding additional molecules, such as a surrogate marker or other markers, or can contain additional components, such as promoters, regulatory elements and/or multicistronic elements. In some embodiments, the nucleic acid sequence encoding the BCMA-binding receptor can be operably linked to any of the additional components.

A. Components of Encoded Recombinant BCMA-Binding Receptors

The provided BCMA-binding receptors generally contain an extracellular binding molecule and an intracellular signaling domain. Among the provided binding molecules are polypeptides containing antibodies, including single chain cell surface proteins, e.g., recombinant receptors such as chimeric antigen receptors, containing such antibodies.

Among the provided binding molecules (e.g., BCMA-binding molecules) are single chain cell surface proteins, such as recombinant receptors (e.g., antigen receptors), that include one of the provided antibodies or fragment thereof (e.g., BCMA-binding fragment). The recombinant receptors include antigen receptors that specifically bind to or specifically recognize BCMA, such as antigen receptors containing the provided anti-BCMA antibodies, e.g., antigen-binding fragments. Among the antigen receptors are functional non-TCR antigen receptors, such as chimeric antigen receptors (CARs). Also provided are cells expressing the recombinant receptors and uses thereof in adoptive cell therapy, such as treatment of diseases and disorders associated with BCMA expression.

Exemplary antigen receptors, including CARs, and methods for engineering and introducing such antigen receptors into cells, include those described, for example, in international patent application publication Nos. WO200014257, WO2013126726, WO2012/129514, WO2014031687, WO2013166321, WO2013071154, WO2013123061 U.S. patent application publication Nos. US2002131960, US2013287748, US20130149337, U.S. Pat. Nos. 6,451,995, 7,446,190, 8,252,592, 8,339,645, 8,398,282, 7,446,179, 6,410,319, 7,070,995, 7,265,209, 7,354,762, 7,446,191, 8,324,353, and 8,479,118, and European patent application No. EP2537416, and/or those described by Sadelain et al., Cancer Discov. 2013 April; 3(4): 388-398; Davila et al. (2013) PLoS ONE 8(4): e61338; Turtle et al., Curr. Opin. Immunol., 2012 October; 24(5): 633-39; Wu et al., Cancer, 2012 Mar. 18(2): 160-75. In some aspects, the antigen receptors include a CAR as described in U.S. Pat. No. 7,446,190, and those described in International Patent Application Publication No. WO2014055668. Exemplary CARs include CARs as disclosed in any of the aforementioned publications, such as WO2014031687, U.S. Pat. Nos. 8,339, 645, 7,446,179, US 2013/0149337, U.S. Pat. Nos. 7,446, 190, and 8,389,282, and in which the antigen-binding portion, e.g., scFv, is replaced by an antibody or an antigen-binding fragment thereof, as provided herein.

In some embodiments, the provided CAR has an amino acid sequence selected from among SEQ ID NOs: 757-762, or exhibits at least or about at least 90%, 91%, 92%, 93%, 94%, 95%, 96%, 97%, 98% or 99% sequence identity to the amino acid sequence set forth in any of SEQ ID NOs 757-762. In some embodiments, the provided CAR is encoded by a polynucleotide, such as an polynucleotide with the nucleic acid sequence set forth in any of SEQ ID NOs 751-756, or a sequences that exhibits at least or at least about 90%, 91%, 92%, 93%, 94%, 95%, 96%, 97%, 98% or 99% sequence identity to the nucleic acid sequence set forth in any of SEQ ID NOs: 751-756.

In some embodiments, the provided CAR is encoded by a polynucleotide, such as an polynucleotide with the nucleic acid sequence set forth in any of SEQ ID NOs:755 and 756, or a sequences that exhibits at least or at least about 90%, 91%, 92%, 93%, 94%, 95%, 96%, 97%, 98% or 99% sequence identity to the nucleic acid sequence set forth in any of SEQ ID NOs: 755 and 756.

In some embodiments, the provided CAR is encoded by a polynucleotide, such as an polynucleotide with the nucleic acid sequence set forth in SEQ ID NOs:755 or a sequences that exhibits at least or at least about 90%, 91%, 92%, 93%, 94%, 95%, 96%, 97%, 98% or 99% sequence identity thereto. In some embodiments, the provided CAR is encoded by a polynucleotide, such as an polynucleotide with the nucleic acid sequence set forth in SEQ ID NOs:755.

In some embodiments, the nucleic acid encoding the antigen-binding domain comprises (a) the sequence of nucleotides set forth in any of SEQ ID NOS: 648, 330-352, 647, 716, or 718; (b) a sequence of nucleotides that has at least 90% sequence identity to any of SEQ ID NOS: 648, 330-352, 647, 716, or 718; or (c) a degenerate sequence of (a) or (b).

1. Antigen-Binding Domain

Among the chimeric receptors are chimeric antigen receptors (CARs). The chimeric receptors, such as CARs, generally include an extracellular antigen binding domain that includes, is, or is comprised within or comprises, one of the provided anti-BCMA antibodies. Thus, the chimeric receptors, e.g., CARs, typically include in their extracellular portions one or more BCMA-binding molecules, such as one or more antigen-binding fragment, domain, or portion, or one or more antibody variable regions, and/or antibody molecules, such as those described herein.

The term "antibody" herein is used in the broadest sense and includes polyclonal and monoclonal antibodies, including intact antibodies and functional (antigen-binding) antibody fragments, including fragment antigen binding (Fab) fragments, F(ab')$_2$ fragments, Fab' fragments, Fv fragments, recombinant IgG (rIgG) fragments, heavy chain variable (V$_H$) regions capable of specifically binding the antigen, single chain antibody fragments, including single chain variable fragments (scFv), and single domain antibodies (e.g., sdAb, sdFv, nanobody) fragments. The term encompasses genetically engineered and/or otherwise modified forms of immunoglobulins, such as intrabodies, peptibodies, chimeric antibodies, fully human antibodies, humanized antibodies, and heteroconjugate antibodies, multispecific, e.g., bispecific or trispecific, antibodies, diabodies, triabodies, and tetrabodies, tandem di-scFv, tandem tri-scFv. Unless otherwise stated, the term "antibody" should be understood to encompass functional antibody fragments thereof also referred to herein as "antigen-binding fragments." The term also encompasses intact or full-length antibodies, including antibodies of any class or sub-class, including IgG and sub-classes thereof, IgM, IgE, IgA, and IgD.

The terms "complementarity determining region," and "CDR," synonymous with "hypervariable region" or "HVR," are known in the art to refer to non-contiguous sequences of amino acids within antibody variable regions, which confer antigen specificity and/or binding affinity. In general, there are three CDRs in each heavy chain variable region (CDR-H1, CDR-H2, CDR-H3) and three CDRs in each light chain variable region (CDR-L1, CDR-L2, CDR-L3). "Framework regions" and "FR" are known in the art to refer to the non-CDR portions of the variable regions of the heavy and light chains. In general, there are four FRs in each full-length heavy chain variable region (FR-H1, FR-H2, FR-H3, and FR-H4), and four FRs in each full-length light chain variable region (FR-L1, FR-L2, FR-L3, and FR-L4).

The precise amino acid sequence boundaries of a given CDR or FR can be readily determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme); Al-Lazikani et al., (1997) JMB 273, 927-948 ("Chothia" numbering scheme); MacCallum et al., J. Mol. Biol. 262: 732-745 (1996), "Antibody-antigen interactions: Contact analysis and binding site topography," J. Mol. Biol. 262, 732-745." ("Contact" numbering scheme); Lefranc M P et al., "IMGT unique numbering for immunoglobulin and T cell receptor variable domains and Ig superfamily V-like domains," Dev Comp Immunol, 2003 January; 27(1):55-77 ("IMGT" numbering scheme); Honegger A and Plückthun A, "Yet another numbering scheme for immunoglobulin variable domains: an automatic modeling and analysis tool," J Mol Biol, 2001 Jun. 8; 309(3):657-70, ("Aho" numbering scheme); and Martin et al., "Modeling antibody hypervariable loops: a combined algorithm," PNAS, 1989, 86(23): 9268-9272, ("AbM" numbering scheme).

The boundaries of a given CDR or FR may vary depending on the scheme used for identification. For example, the Kabat scheme is based on structural alignments, while the Chothia scheme is based on structural information. Numbering for both the Kabat and Chothia schemes is based upon the most common antibody region sequence lengths, with insertions accommodated by insertion letters, for example, "30a," and deletions appearing in some antibodies. The two schemes place certain insertions and deletions ("indels") at different positions, resulting in differential numbering. The Contact scheme is based on analysis of complex crystal structures and is similar in many respects to the Chothia numbering scheme. The AbM scheme is a compromise between Kabat and Chothia definitions based on that used by Oxford Molecular's AbM antibody modeling software.

Table 1, below, lists exemplary position boundaries of CDR-L1, CDR-L2, CDR-L3 and CDR-H1, CDR-H2, CDR-H3 as identified by Kabat, Chothia, AbM, and Contact schemes, respectively. For CDR-H1, residue numbering is listed using both the Kabat and Chothia numbering schemes. FRs are located between CDRs, for example, with FR-L1 located before CDR-L1, FR-L2 located between CDR-L1 and CDR-L2, FR-L3 located between CDR-L2 and CDR-L3 and so forth. It is noted that because the shown Kabat numbering scheme places insertions at H35A and H35B, the end of the Chothia CDR-H1 loop when numbered using the shown Kabat numbering convention varies between H32 and H34, depending on the length of the loop.

TABLE 1

Boundaries of CDRs according to various numbering schemes.

| CDR | Kabat | Chothia | AbM | Contact |
|---|---|---|---|---|
| CDR-L1 | L24--L34 | L24--L34 | L24--L34 | L30--L36 |
| CDR-L2 | L50--L56 | L50--L56 | L50--L56 | L46--L55 |
| CDR-L3 | L89--L97 | L89--L97 | L89--L97 | L89--L96 |
| CDR-H1 (Kabat Numbering[1]) | H31--H35B | H26--H32.34 | H26--H35B | H30--H35B |
| CDR-H1 (Chothia Numbering[2]) | H31--H35 | H26--H32 | H26--H35 | H30--H35 |
| CDR-H2 | H50--H65 | H52--H56 | H50--H58 | H47--H58 |
| CDR-H3 | H95--H102 | H95--H102 | H95--H102 | H93--H101 |

[1]Kabat et al. (1991), "Sequences of Proteins of Immunological Interest," 5th Ed. Public Health Service, National Institutes of Health, Bethesda, MD
[2]Al-Lazikani et al., (1997) JMB 273,927-948

Thus, unless otherwise specified, a "CDR" or "complementary determining region," or individual specified CDRs (e.g., CDR-H1, CDR-H2, CDR-H3), of a given antibody or region thereof, such as a variable region thereof, should be understood to encompass a (or the specific) complementary determining region as defined by any of the aforementioned schemes, or other known schemes. For example, where it is stated that a particular CDR (e.g., a CDR-H3) contains the amino acid sequence of a corresponding CDR in a given $V_H$ or $V_L$ region amino acid sequence, it is understood that such a CDR has a sequence of the corresponding CDR (e.g., CDR-H3) within the variable region, as defined by any of the aforementioned schemes, or other known schemes. In some embodiments, specific CDR sequences are specified. Exemplary CDR sequences of provided antibodies are described using various numbering schemes, although it is understood that a provided antibody can include CDRs as described according to any of the other aforementioned numbering schemes or other numbering schemes known to a skilled artisan.

Likewise, unless otherwise specified, a FR or individual specified FR(s) (e.g., FR-H1, FR-H2, FR-H3, FR-H4), of a given antibody or region thereof, such as a variable region thereof, should be understood to encompass a (or the specific) framework region as defined by any of the known schemes. In some instances, the scheme for identification of a particular CDR, FR, or FRs or CDRs is specified, such as the CDR as defined by the Kabat, Chothia, AbM or Contact method, or other known schemes. In other cases, the particular amino acid sequence of a CDR or FR is given.

The term "variable region" or "variable domain" refers to the domain of an antibody heavy or light chain that is involved in binding the antibody to antigen. The variable regions of the heavy chain and light chain ($V_H$ and $V_L$, respectively) of a native antibody generally have similar structures, with each domain comprising four conserved framework regions (FRs) and three CDRs. (See, e.g., Kindt et al. Kuby Immunology, 6th ed., W.H. Freeman and Co., page 91 (2007). A single $V_H$ or $V_L$ domain may be sufficient to confer antigen-binding specificity. Furthermore, antibodies that bind a particular antigen may be isolated using a $V_H$ or $V_L$ domain from an antibody that binds the antigen to screen a library of complementary $V_L$ or $V_H$ domains, respectively. See, e.g., Portolano et al., J. Immunol. 150: 880-887 (1993); Clarkson et al., Nature 352:624-628 (1991).

Among the antibodies included in the provided CARs are antibody fragments. An "antibody fragment" or "antigen-binding fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies; linear antibodies; heavy chain variable ($V_H$) regions, single-chain antibody molecules such as scFvs and single-domain antibodies comprising only the $V_H$ region; and multispecific antibodies formed from antibody fragments. In some embodiments, the antigen-binding domain in the provided CARs is or comprises an antibody fragment comprising a variable heavy chain ($V_H$) and a variable light chain ($V_L$) region. In particular embodiments, the antibodies are single-chain antibody fragments comprising a heavy chain variable ($V_H$) region and/or a light chain variable ($V_L$) region, such as scFvs.

Single-domain antibodies (sdAbs) are antibody fragments comprising all or a portion of the heavy chain variable region or all or a portion of the light chain variable region of an antibody. In certain embodiments, a single-domain antibody is a human single-domain antibody.

Antibody fragments can be made by various techniques, including but not limited to proteolytic digestion of an intact antibody as well as production by recombinant host cells. In some embodiments, the antibodies are recombinantly-produced fragments, such as fragments comprising arrangements that do not occur naturally, such as those with two or more antibody regions or chains joined by synthetic linkers, e.g., peptide linkers, and/or that are may not be produced by enzyme digestion of a naturally-occurring intact antibody. In some aspects, the antibody fragments are scFvs.

A "humanized" antibody is an antibody in which all or substantially all CDR amino acid residues are derived from non-human CDRs and all or substantially all FR amino acid residues are derived from human FRs. A humanized antibody optionally may include at least a portion of an antibody constant region derived from a human antibody. A "humanized form" of a non-human antibody, refers to a variant of the non-human antibody that has undergone humanization, typically to reduce immunogenicity to humans, while retaining the specificity and affinity of the parental non-human antibody. In some embodiments, some FR residues in a humanized antibody are substituted with corresponding residues from a non-human antibody (e.g., the antibody from which the CDR residues are derived), e.g., to restore or improve antibody specificity or affinity.

Among the anti-BCMA antibodies included in the provided CARs are human antibodies. A "human antibody" is an antibody with an amino acid sequence corresponding to that of an antibody produced by a human or a human cell, or non-human source that utilizes human antibody repertoires or other human antibody-encoding sequences, including human antibody libraries. The term excludes humanized forms of non-human antibodies comprising non-human antigen-binding regions, such as those in which all or substantially all CDRs are non-human. The term includes antigen-binding fragments of human antibodies.

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic animals, the endogenous immunoglobulin loci have generally been inactivated. Human antibodies also may be derived from human antibody libraries, including phage display and cell-free libraries, containing antibody-encoding sequences derived from a human repertoire.

Among the antibodies included in the provided CARs are those that are monoclonal antibodies, including monoclonal antibody fragments. The term "monoclonal antibody" as used herein refers to an antibody obtained from or within a population of substantially homogeneous antibodies, i.e., the individual antibodies comprising the population are identical, except for possible variants containing naturally occurring mutations or arising during production of a monoclonal antibody preparation, such variants generally being present in minor amounts. In contrast to polyclonal antibody preparations, which typically include different antibodies directed against different epitopes, each monoclonal antibody of a monoclonal antibody preparation is directed against a single epitope on an antigen. The term is not to be construed as requiring production of the antibody by any particular method. A monoclonal antibody may be made by a variety of techniques, including but not limited to generation from a hybridoma, recombinant DNA methods, phage-display and other antibody display methods.

In some embodiments, the CAR includes a BCMA-binding portion or portions of the antibody molecule, such as a heavy chain variable ($V_H$) region and/or light chain variable ($V_L$) region of the antibody, e.g., an scFv antibody fragment. In some embodiments, the provided BCMA-binding CARs contain an antibody, such as an anti-BCMA antibody, or an antigen-binding fragment thereof that confers the BCMA-binding properties of the provided CAR. In some embodiments, the antibody or antigen-binding domain can be any anti-BCMA antibody described or derived from any anti-BCMA antibody described. See, e.g., Carpenter et al., Clin Cancer Res., 2013, 19(8):2048-2060, WO 2016090320, WO2016090327, WO2010104949 and WO2017173256. Any of such anti-BCMA antibodies or antigen-binding fragments can be used in the provided CARs. In some embodiments, the anti-BCMA CAR contains an antigen-binding domain that is an scFv containing a variable heavy ($V_H$) and/or a variable light ($V_L$) region derived from an antibody described in WO 2016090320 or WO2016090327.

In some embodiments, the antibody, e.g., the anti-BCMA antibody or antigen-binding fragment, contains a heavy and/or light chain variable ($V_H$ or $V_L$) region sequence as described, or a sufficient antigen-binding portion thereof. In some embodiments, the anti-BCMA antibody, e.g., antigen-binding fragment, contains a $V_H$ region sequence or sufficient antigen-binding portion thereof that contains a CDR-H1, CDR-H2 and/or CDR-H3 as described. In some embodiments, the anti-BCMA antibody, e.g., antigen-binding fragment, contains a $V_L$ region sequence or sufficient antigen-binding portion that contains a CDR-L1, CDR-L2 and/or CDR-L3 as described. In some embodiments, the anti-BCMA antibody, e.g., antigen-binding fragment, contains a $V_H$ region sequence that contains a CDR-H1, CDR-H2 and/or CDR-H3 as described and contains a $V_L$ region sequence that contains a CDR-L1, CDR-L2 and/or CDR-L3 as described. Also among the antibodies are those having sequences at least at or about 90%, about 91%, about 92%, about 93%, about 94%, about 95%, about 96%, about 97%, about 98%, or about 99% identical to such a sequence.

In some embodiments, the antibody, e.g., antigen-binding fragment thereof, in the provided CAR, has a heavy chain variable ($V_H$) region having the amino acid sequence selected from any one of SEQ ID NOs:110-115, 247-256, 324, 325, 518-531, 533, 609, 617, and 772-774, and 814-832, or an amino acid sequence that has at least 90%, 91%, 92%, 93%, 94%, 95%, 96%, 97%, 98%, or 99% sequence identity to the $V_H$ region amino acid selected from any one of SEQ ID NOs:110-115, 247-256, 324, 325, 518-531, 533, 609, 617, 772-774, and 814-832, or contains a CDR-H1, CDR-H2, and/or CDR-H3 present in such a $V_H$ sequence. In some embodiments, the antibody or antibody fragment, in the provided CAR, has a $V_H$ region of any of the antibodies or antibody binding fragments described in WO 2016090327, WO 2016090320, or WO 2017173256.

In some embodiments, the $V_H$ region of the anti-BCMA antibody is one that includes a heavy chain complementarity determining region 3 (CDR-H3) comprising the amino acid sequence $X_1X_2X_3X_4X_5X_6X_7X_8X_9X_{10}X_{11}X_{12}X_{13}X_{14}$ (SEQ ID NO:355), wherein $X_1$ is A, D, E, G, L, V or W; $X_2$ is A, D, G, L, P, Q or S; $X_3$ is A, D, G, L or Y; $X_4$ is D, G, P, R, S, V, Y or null; $X_5$ is D, I, P, S, T, Y or null; $X_6$ is A, G, I, S, T, V, Y or null; $X_7$ is A, D, E, F, L, P, S, Y or null; $X_8$ is P, Q, T, Y or null; $X_9$ is D, G, R, Y or null; $X_{10}$ is A, F, Y or null; $X_{ii}$ is D, F or null; $X_{12}$ is F or null; $X_{13}$ is D, T or Y; and $X_{14}$ is I, L, N, V or Y. In some such embodiments, in said CDR-H3, $X_1$ is V; $X_2$ is D; $X_3$ is G; $X_4$ is D; $X_5$ is Y; $X_6$ is V; $X_7$ is D; $X_8$ is null; $X_9$ is null; $X_{10}$ is null; $X_{ii}$ is null; $X_{12}$ is null; $X_{13}$ is D; and $X_{14}$ is Y.

In some embodiments, the antibody or antigen-binding fragment thereof comprises a CDR-H3 comprising the amino acid sequence selected from any one of SEQ ID NOs:7-11, 149-157, 279-287, 292, 293, 376-378, 517, 595, according to Kabat numbering. In some embodiments, the $V_H$ region of an antibody or antigen-binding fragment thereof contains a CDR-H3 having the amino acid sequence comprising the amino acid sequence selected from any one of SEQ ID NOs:7-11, 149-157, 279-287, 292, 293, 376-378, 517, and 595 according to Chothia numbering or AbM numbering. In some embodiments, the VH region of an antibody or antigen-binding fragment thereof contains a CDR-H3 having the amino acid sequence comprising the amino acid sequence selected from SEQ ID NOs: 606 and 613. In some embodiments, the antibody or antigen-binding fragment thereof contains a CDR-H3 having the amino acid sequence of SEQ ID NO: 517, 595, 606, or 613. In any of such examples, the antibody or antigen-binding fragment thereof can contain a $V_H$ region sequence selected from any one of SEQ ID NOs:110-115, 247-256, 324, 325, 518-531, 533, 609, 617, 772-774, and 814-832 in which the corresponding CDR-H3 sequence contained therein (e.g. corresponding to amino acid residues H95 to H102 by Kabat numbering) is replaced by the CDR-H3 sequence selected from any one of SEQ ID NOs:7-11, 149-157, 279-287, 292, 293, 376-378, 517, and 595 according to Kabat numbering, any one of SEQ ID NOs:7-11, 149-157, 279-287, 292, 293, 376-378, 517, and 595 according to Chothia numbering or AbM numbering, or any one of SEQ ID NOs: 606 and 613.

In some embodiments, the $V_H$ region of an antibody or antigen-binding fragment thereof comprises a CDR-H3 contained within the $V_H$ region amino acid sequence selected from any one of SEQ ID NOs: 110-115, 247-256, 324, 325, 518-531, 533, 609, 617, 772-774, and 814-832.

In some embodiments, the $V_H$ region of the antibody or antigen-binding fragment thereof is one that includes a heavy chain complementarity determining region 1 (CDR-H1) comprising the amino acid sequence of $X_1X_2X_3MX_4$ (SEQ ID NO:353) $X_1$ is D or S; $X_2$ is Y or S; $X_3$ is A, G, W, or Y; and $X_4$ is H, Q, or S. In some embodiments, in said CDR-H1, $X_1$ is D; $X_2$ is Y; $X_3$ is Y; and $X_4$ is S.

In some embodiments, the $V_H$ region of an antibody or antigen-binding fragment thereof contains a CDR-H1 having the amino acid sequence comprising the amino acid sequence selected from any one of SEQ ID NOs:1-3, 140-144, 288, 289, 507, and 593 according to Kabat numbering. In some embodiments, the $V_H$ region of an antibody or antigen-binding fragment thereof contains a CDR-H1 having the amino acid sequence comprising the amino acid sequence selected from any one of SEQ ID NOs:12-15, 158-160, 294, 295, 532, and 596 according to Chothia numbering. In some embodiments, the $V_H$ region of an antibody or antigen-binding fragment thereof contains a CDR-H1 having the amino acid sequence comprising the amino acid sequence selected from any one of SEQ ID NOs:19-22, 165-169, 298, 299, 509, 577, and 598 according to AbM numbering. In some embodiments, the $V_H$ region of an antibody or antigen-binding fragment thereof contains a CDR-H1 having the amino acid sequence comprising the amino acid sequence selected from any one of SEQ ID NOs 604, and 611. In some embodiments, the $V_H$ region of an antibody or antigen-binding fragment thereof contains a CDR-H1 having the amino acid sequence of SEQ ID NO:507, 532, 577, 593, 596, 598, 604, and 611. In any of such examples, the antibody or antigen-binding fragment thereof can contain a $V_H$ region sequence selected from any one of SEQ ID NOs:110-115, 247-256, 324, 325, 518-531, 533, 609, 617, 772-774, and 814-832 in which the corresponding CDR-H1 sequence contained therein (e.g. corresponding to amino acid residues H31 to H35 by Kabat numbering) is replaced by the CDR-H1 sequence selected from any one of SEQ ID NOs:1-3, 140-144, 288, 289, 507, and 593 according to Kabat numbering, any one of SEQ ID NOs:12-15, 158-160, 294, 295, 532, and 596 according to Chothia numbering, any one of SEQ ID NOs:19-22, 165-169, 509, 298, 299, 509, 577, and 598 according to AbM numbering, or any one of SEQ ID NOs: 604 and 611.

In some embodiments, the $V_H$ region of an antibody or antigen-binding fragment thereof contains a CDR-H1 contained within the $V_H$ region amino acid sequence selected from any one of SEQ ID NOs:110-115, 247-256, 324, 325, 518-531, 533, 609, 617, 772-774, and 814-832.

In some embodiments, the $V_H$ region of an antibody or antigen-binding fragment thereof is one that includes a heavy chain complementarity determining region 2 (CDR-H2) comprising the amino acid sequence of $X_1IX_2X_3X_4X_5X_6X_7X_8X_9X_{10}X_{11}YX_{12}X_{13}X_{14}X_{15}X_{16}X_{17}$ (SEQ ID NO:354), wherein $X_1$ is F, G, H, V, W or Y; $X_2$ is N, R, S or V; $X_3$ is P, Q, S, V, W or Y; $X_4$ is K or null; $X_5$ is A or null; $X_6$ is D, G, N, S, or Y; $X_7$ is G or S; $X_8$ is G or S; $X_9$ is E, G, N, T or S; $X_{10}$ is I, K, or T; $X_{11}$ is E, G, N or Y; $X_{12}$ is A or V; $X_{13}$ is A, D or Q; $X_{14}$ is K or S; $X_{15}$ is F or V; $X_{16}$ is K or Q; and $X_{17}$ is E or G. In some embodiments in said CDR-H2, $X_1$ is Y; $X_2$ is 5, $X_3$ is S; $X_4$ is null; $X_5$ is null; $X_6$ is S; $X_7$ is G; $X_8$ is S; $X_9$ is T; $X_{10}$ is I; $X_{ii}$ is Y; $X_{12}$ is A; $X_{13}$ is D; $X_{14}$ is S; $X_{15}$ is V; $X_{16}$ is K; and $X_{17}$ is G.

In some embodiments, the $V_H$ region of an antibody or antigen-binding fragment thereof contains a CDR-H2 comprising the amino acid sequence selected from any one of SEQ ID NOs: 4-6, 145-148, 290, 291, 372-374, 513, and 594 according to Kabat numbering. In some embodiments, the $V_H$ region of an antibody or antigen-binding fragment thereof contains a CDR-H2 comprising the amino acid sequence selected from any one of SEQ ID NOs:16-18, 161-164, 296, 297, 514-516, 551, 597 according to Chothia numbering. In some embodiments, the V_H region of an antibody or antigen-binding fragment thereof contains a CDR-H2 comprising the amino acid sequence selected from any one of SEQ ID NOs: 23-25, 170-173, 300, 301, 510-512, 587, and 599 according to AbM numbering. In some embodiments, the V_H region of an antibody or antigen-binding fragment thereof contains a CDR-H2 comprising the amino acid sequence selected from any one of SEQ ID NOs: 605 and 612. In some embodiments, the V_H region of an antibody or antigen-binding fragment thereof contains a CDR-H2 having the amino acid sequence of any of SEQ ID NOs: 513, 551, 587, 594, 597, 599, 605, or 612. In any of such examples, the antibody or antigen-binding fragment thereof can contain a V_H region sequence selected from any one of SEQ ID NOs:110-115, 247-256, 324, 325, 518-531, 533, 609, 617, 772-774, and 814-832 in which the corresponding CDR-H2 sequence contained therein (e.g. corresponding to amino acid residues H50 to H65 by Kabat numbering) is replaced by the CDR-H2 sequence selected from any one of SEQ ID NOs: 4-6, 145-148, 290, 291, 372-374, 513, and 594 according to Kabat numbering, any one of SEQ ID NOs: 16-18, 161-164, 296, 297, 514-516, 551, 597 according to Chothia numbering, any one of SEQ ID NOs: 23-25, 170-173, 300, 301, 510-512, 587, and 599 according to AbM numbering, or any one of SEQ ID NOs 605 or 612.

In some embodiments, the V_H region of an antibody or antigen-binding fragment thereof contains a CDR-H2 contained within the V_H region amino acid sequence selected from any one of SEQ ID NOs: 110-115, 247-256, 324, 325, 518-531, 533, 609, 617, 772-774, and 814-832.

In some embodiments, the antibody or antigen-binding fragment thereof contains a CDR-H1 that is or comprises the amino acid sequence selected from any one of SEQ ID NOs:1-3, 140-144, 288, 289, 507, and 593 according to Kabat numbering; a CDR-H2 that is or comprises the amino acid sequence selected from any one of SEQ ID NOs: 4-6, 145-148, 290, 291, 372-374, 513, and 594 according to Kabat numbering; and a CDR-H3 that is or comprises the amino acid sequence selected from any one of SEQ ID NOs: 7-11, 149-157, 279-287, 292, 293, 376-378, 517, and 595 according to Kabat numbering. In some embodiments, the antibody or antigen-binding fragment thereof contains a CDR-H1 that is or comprises the amino acid sequence selected from any one of SEQ ID NOs:12-15, 158-160, 294, 295, 532, and 596 according to Chothia numbering; a CDR-H2 that is or comprises the amino acid sequence selected from any one of SEQ ID NOs: 16-18, 161-164, 296, 297, 514-516, 551, 597 according to Chothia numbering; and a CDR-H3 that is or comprises the amino acid sequence selected from any one of SEQ ID NOs: 7-11, 149-157, 279-287, 292, 293, 376-378, 517, and 595 according to Chothia numbering. In some embodiments, the antibody or antigen-binding fragment thereof contains a CDR-H1 that is or comprises the amino acid sequence selected from any one of SEQ ID NO:19-22, 165-169, 509, 298, 299, 509, 577, and 598 according to AbM numbering; a CDR-H2 that is or comprises the amino acid sequence selected from any one of SEQ ID NOs:23-25, 170-173, 300, 201, 510-512, 587, and 599 according to AbM numbering; and a CDR-H3 that is or comprises the amino acid sequence selected from any one of SEQ ID NOs:7-11, 149-157, 279-287, 292, 293, 376-378, 517, 595, 606, and 613 according to AbM numbering. In some embodiments, the antibody or antigen-binding fragment thereof contains a CDR-H1 that is or comprises the amino acid sequence selected from any one of SEQ ID NO:604 and 611; a CDR-H2 that is or comprises the amino acid sequence selected from any one of SEQ ID NOs:605 and 612; and a CDR-H3 that is or comprises the amino acid sequence selected from any one of SEQ ID NOs:606 and 613.

In some embodiments, the V_H region of an antibody or antigen-binding fragment thereof comprises a CDR-H1, CDR-H2, and/or CDR-H3 according to Kabat numbering. In some embodiments, the V_H region of an antibody or antigen-binding fragment thereof comprises a CDR-H1, CDR-H2, and/or CDR-H3 according to Chothia numbering. In some embodiments, the V_H region of an antibody or antigen-binding fragment thereof comprises a CDR-H1, CDR-H2, and/or CDR-H3 according to AbM numbering.

In some embodiments, the antibody or antigen-binding fragment thereof comprises an V_H region comprising a CDR-H1, CDR-H2, and CDR-H3 selected from the group consisting of: a CDR-H1, CDR-H2, and CDR-H3 comprising the amino acid sequence of SEQ ID NOs:1, 4, and 7, respectively; a CDR-H1, CDR-H2, and CDR-H3 comprising the amino acid sequence of SEQ ID NOs:2, 5, and 8, respectively; a CDR-H1, CDR-H2, and CDR-H3 comprising the amino acid sequence of SEQ ID NOs:2, 5, and 9, respectively; a CDR-H1, CDR-H2, and CDR-H3 comprising the amino acid sequence of SEQ ID NOs:2, 5, and 10, respectively; a CDR-H1, CDR-H2, and CDR-H3 comprising the amino acid sequence of SEQ ID NOs:3, 6, and 11, respectively; a CDR-H1, CDR-H2, and CDR-H3 comprising the amino acid sequence of SEQ ID NOs:140, 145, and 149, respectively; a CDR-H1, CDR-H2, and CDR-H3 comprising the amino acid sequence of SEQ ID NOs:141, 145, and 149, respectively; a CDR-H1, CDR-H2, and CDR-H3 comprising the amino acid sequence of SEQ ID NOs:141, 145, and 150, respectively; a CDR-H1, CDR-H2, and CDR-H3 comprising the amino acid sequence of SEQ ID NOs: 142, 146, and 151, respectively; a CDR-H1, CDR-H2, and CDR-H3 comprising the amino acid sequence of SEQ ID NOs:2, 5, and 152, respectively; a CDR-H1, CDR-H2, and CDR-H3 comprising the amino acid sequence of SEQ ID NOs:143, 147, and 153, respectively; a CDR-H1, CDR-H2, and CDR-H3 comprising the amino acid sequence of SEQ ID NOs:144, 148, and 154, respectively; a CDR-H1, CDR-H2, and CDR-H3 comprising the amino acid sequence of SEQ ID NOs:3, 6, and 155, respectively; a CDR-H1, CDR-H2, and CDR-H3 comprising the amino acid sequence of SEQ ID NOs:2, 5, and 156, respectively; a CDR-H1, CDR-H2, and CDR-H3 comprising the amino acid sequence of SEQ ID NOs:2, 5, and 157, respectively; a CDR-H1, CDR-H2, and CDR-H3 comprising the amino acid sequence of SEQ ID NOs:2, 6, and 376, respectively; a CDR-H1, CDR-H2, and CDR-H3 comprising the amino acid sequence of SEQ ID NOs:3, 372, and 376, respectively; a CDR-H1, CDR-H2, and CDR-H3 comprising the amino acid sequence of SEQ ID NOs:3, 6, and 376, respectively; a CDR-H1, CDR-H2, and CDR-H3 comprising the amino acid sequence of SEQ ID NOs:3, 6, and 377, respectively; a CDR-H1, CDR-H2, and CDR-H3 comprising the amino acid sequence of SEQ ID NOs:2, 373, and 152, respectively; a CDR-H1, CDR-H2, and CDR-H3 comprising the amino acid sequence of SEQ ID NOs:2, 5, and 378, respectively; a CDR-H1, CDR-H2, and CDR-H3 comprising the amino acid sequence of SEQ ID NOs:2, 374, and 9; a CDR-H1, CDR-H2, and CDR-H3 comprising the amino acid sequence of SEQ ID NOs:288, 290, and 292; a CDR-H1, CDR-H2, and CDR-H3 comprising the amino acid sequence of SEQ ID NOs:289, 291, 293; a CDR-H1, CDR-H2, and CDR-H3 comprising the amino acid sequence of SEQ ID NOs:507, 513, and 517; a CDR-H1, CDR-H2, and CDR-H3 comprising the amino acid sequence of SEQ ID NOs:593, 594, and 595, respectively, according to Kabat numbering.

For example, the antibody or antigen-binding fragment thereof provided herein comprises a $V_H$ region comprising a CDR-H1, CDR-H2, and CDR-H3 comprising the amino acid sequence selected from among: SEQ ID NOs:1, 4, and 7; SEQ ID NOs:2, 5, and 8; SEQ ID NOs:2, 5, and 9; SEQ ID NOs:2, 5, and 10; SEQ ID NOs:3, 6, and 11; SEQ ID NOs:140, 145, and 149; SEQ ID NOs:141, 145, and 149; SEQ ID NOs:141, 145, and 150; SEQ ID NOs:142, 146, and 151; SEQ ID NOs:2, 5, and 152; SEQ ID NOs:143, 147, and 153; SEQ ID NOs:144, 148, and 154; SEQ ID NOs:3, 6, and 155; SEQ ID NOs:2, 5, and 156; SEQ ID NOs:2, 5, and 157; SEQ ID NOs:2, 6, and 376; SEQ ID NOs:3, 372, and 376; SEQ ID NOs:3, 6, and 376; SEQ ID NOs:3, 6, and 377; SEQ ID NOs:2, 373, and 152; SEQ ID NOs:2, 5, and 378; SEQ ID NOs:2, 374, and 9, SEQ ID NOs:288, 290, and 292; SEQ ID NOs:289, 291, 293; SEQ ID NOs:507, 513, and 517; and SEQ ID NOs:593, 594, and 595, respectively, according to Kabat numbering.

In some embodiments, the antibody or antigen-binding fragment thereof comprises a CDR-H1, CDR-H2 and CDR-H3, respectively, comprising the amino acid sequence of a CDR-H1, a CDR-H2, and a CDR-H3 contained within the $V_H$ region amino acid sequence selected from any one of SEQ ID NOs: 110-115, 247-256, 324, 325, 518-531, 533, 609, 617, 772-774, and 814-832. In some embodiments, the antibody or antigen-binding fragment thereof comprises a CDR-H1, CDR-H2 and CDR-H3, respectively, comprising the amino acid sequence of a CDR-H1, a CDR-H2, and a CDR-H3 contained within the $V_H$ region amino acid sequence of SEQ ID NO:609 or SEQ ID NO: 617. In some embodiments, the antibody or antigen-binding fragment thereof comprises a $V_H$ region that comprises a CDR-H1, CDR-H2, and CDR-H3 comprising the amino acid sequence of SEQ ID NOS:593, 594, and 595, respectively; SEQ ID NOS: 596, 597, and 595, respectively; SEQ ID NOS: 598, 599, and 595, respectively; or SEQ ID NOS: 611, 612, and 613, respectively.

In some embodiments of the antibody or antigen-binding fragment thereof provided herein, the $V_H$ region comprises any of the CDR-H1, CDR-H2 and CDR-H3 as described and comprises a framework region 1 (FR1), a FR2, a FR3 and/or a FR4 having at least 90%, 91%, 92%, 93%, 94%, 95%, 96%, 97%, 98%, or 99% sequence identity, respectively, to a FR1, a FR2, a FR3 and/or a FR4 contained within the $V_H$ region amino acid sequence selected from any one of SEQ ID NOs: 110-115, 247-256, 324, 325, 518-531, 533, 609, 617, 772-774, and 814-832. For example, the anti-BCMA antibody or antigen-binding fragment thereof can comprise a CDR-H1, CDR-H2 and CDR-H3, respectively, contained within the $V_H$ region amino acid sequence selected from any one of SEQ ID NOs: 110-115, 247-256, 324, 325, 518-531, 533, 609, 617, 772-774, and 814-832, and a framework region (e.g., a FR1, a FR2, a FR3 and/or a FR4) that contains at least 90%, 91%, 92%, 93%, 94%, 95%, 96%, 97%, 98%, 99% sequence identity to a framework region (e.g., a FR1, a FR2, a FR3 and/or a FR4) contained within the $V_H$ region amino acid sequence selected from any one of SEQ ID NOs: 110-115, 247-256, 324, 325, 518-531, 533, 609, 617, 772-774, and 814-832. In some embodiments, the $V_H$ region comprises a FR1, a FR2, a FR3 and/or a FR4 selected from a FR1 comprising the amino acid sequence selected from any one of SEQ ID NOs:59-63, 195-203, 308, 309, and 434-439; a FR2 comprising the amino acid sequence selected from any one of SEQ ID NOs:64-66, 204-209, 310, and 311; a FR3 comprising the amino acid sequence selected from any one of SEQ ID NOs:67-69, 210-216, 312, 313, 441 and 443; and/or a FR4 comprising the amino acid sequence selected from any one of SEQ ID NOs:70-71, 217-220, 314, 315, 444 and 445. In some embodiments, the $V_H$ region comprises a FR1 comprising the amino acid sequence of SEQ ID NO:61, a FR2 comprising the amino acid sequence of SEQ ID NO:65, a FR3 comprising the amino acid sequence of SEQ ID NO:69, and/or a FR4 comprising the amino acid of SEQ ID NO:70.

In some embodiments, the antibody or antigen-binding fragment thereof comprises a $V_H$ region comprising the amino acid sequence selected from any one of SEQ ID NOs: 110-115, 247-256, 324, 325, 518-531, 533, 609, 617, 772-774, and 814-832.

Also provided are antibodies and antigen-binding fragments thereof having sequences at least at or about at least 90%, 91%, 92%, 93%, 94%, 95%, 96%, 97%, 98%, or 99% identical to such sequences. For example, provided herein is an antibody or antigen-binding fragment comprising a $V_H$ region comprising an amino acid sequence having at least 90%, 91%, 92%, 93%, 94%, 95%, 96%, 97%, 98%, or 99% sequence identity to a $V_H$ region amino acid sequence selected from any one of SEQ ID NOs: 110-115, 247-256, 324, 325, 518-531, 533, 609, 617, 772-774, and 814-832.

In some embodiments, the antibody is a single domain antibody (sdAb) comprising only a $V_H$ region sequence or a sufficient antigen-binding portion thereof, such as any of the above described $V_H$ sequences (e.g., a CDR-H1, a CDR-H2, a CDR-H3 and/or a CDR-H4).

In some embodiments, an antibody provided herein (e.g., an anti-BCMA antibody) or antigen-binding fragment thereof comprising a $V_H$ region further comprises a light chain or a sufficient antigen binding portion thereof. For example, in some embodiments, the antibody or antigen-binding fragment thereof contains a $V_H$ region and a $V_L$ region, or a sufficient antigen-binding portion of a $V_H$ and $V_L$ region. In such embodiments, a $V_H$ region sequence can be any of the above described $V_H$ sequence. In some such embodiments, the antibody is an antigen-binding fragment, such as a Fab or an scFv. In some such embodiments, the antibody is a full-length antibody that also contains a constant region.

In some embodiments, the antibody, e.g., antigen-binding fragment thereof, has a light chain variable ($V_L$) region having the amino acid sequence selected from any one of SEQ ID NOs:116-127, 257-267, 326, 327, 534-550, 552-557, 610, 618, 775-777, and 833-849, or an amino acid sequence that has at least 90%, 91%, 92%, 93%, 94%, 95%, 96%, 97%, 98%, or 99% sequence identity to a $V_L$ region amino acid sequence selected from any one of SEQ ID NOs: 116-127, 257-267, 326, 327, 534-550, 552-557, 610, 618, 775-777, and 833-849. In some embodiments, the antibody or antigen-binding fragment has a VL region described in any of WO 2016090327, WO 2016090320, or WO 2017173256

In some embodiments, the $V_L$ region of the antibody described herein (e.g., an anti-BCMA antibody) or antigen-binding fragment thereof is one that includes a light chain complementarity determining region 3 (CDR-L3) comprising the amino acid sequence $X_1X_2X_3X_4X_5X_6X_7X_8X_9X_{10}X_{11}X_{12}$, (SEQ ID NO:358), wherein $X_1$ is A, C, G, H, I, Q or S; $X_2$ is A, Q, S or V; $X_3$ is S, W or Y; $X_4$ is D, F, G, H or Y; $X_5$ is D, G, M, R, S or T; $X_6$ is A, G, H, L, R, S, T or Y; $X_7$ is L, P, R, S or null; $X_8$ is D, G, N, R, S, T or null; $X_9$ is A, G, H, L, P or null; $X_{10}$ is F, S or null; $X_{11}$ is L, P, W or Y; and $X_{12}$ is S, T or V. In some embodiments, in said CDR-L3, $X_1$ is H; $X_2$ is V; $X_3$ is W; $X_4$ is D; $X_5$ is R; $X_6$ is S; $X_7$ is R; $X_8$ is D; $X_9$ is H; $X_{10}$ is null; $X_{ii}$ is Y; and $X_{12}$ is V.

In some embodiments, the antibody or antigen-binding fragment thereof contains a CDR-L3 comprising the amino acid sequence selected from any one of SEQ ID NOs:47-58, 184-194, 306, 307, 415-427, 429-433, 591 and 603 according to Kabat numbering, Chothia numbering or AbM numbering. In some embodiments, the antibody or antigen-binding fragment thereof contains a CDR-L3 having the amino acid sequence of SEQ ID NO:591 or 603 according to Kabat numbering, Chothia numbering or AbM numbering. In any of such examples, the antibody or antigen-binding fragment thereof can contain a $V_L$ region sequence selected from any one of SEQ ID NOs: 116-127, 257-267, 326, 327, 534-550, 552-557, 610, 618, 775-777, and 833-849 in which the corresponding CDR-L3 sequence contained therein (e.g. corresponding to amino acid residues L89 to L97 by Kabat numbering) is replaced by the CDR-L3 sequence selected from any one of SEQ ID NOs: 47-58, 184-194, 306, 307, 415-427, 429-433, 591 and 603 according to Kabat numbering, Chothia numbering or AbM numbering.

In some embodiments, the $V_L$ region of an antibody or antigen-binding fragment thereof comprises a CDR-L3 contained within the $V_L$ region amino acid sequence selected from any one of SEQ ID NOs: 116-127, 257-267, 326, 327, 534-550, 552-557, 610, 618, 775-777, and 833-849. In some embodiments, the $V_L$ region of an antibody or antigen-binding fragment thereof comprises a CDR-L3 contained within the $V_L$ region amino acid sequence of SEQ ID NO:610 or SEQ ID NO: 618.

In some embodiments, the $V_L$ region of the antibody described herein (e.g., an anti-BCMA antibody) or antigen-binding fragment thereof is one that includes a light chain complementarity determining region 1 (CDR-L1) that contains the amino acid sequence: $X_1X_2X_3X_4X_5X_6X_7X_8X_9X_{10}X_{11}X_{12}X_{13}X_{14}X_{15}X_{16}X_{17}$ (SEQ ID NO:356), wherein $X_1$ is G, K, R, S or T; $X_2$ is A, G or S; $X_3$ is G, N, S or T; $X_4$ is G, K, N, Q, R or S; $X_5$ is S or null; $X_6$ is D, N, V or null; $X_7$ is L, V or null; $X_8$ is H, S, Y or null; $X_9$ is S, T or null; $X_{10}$ is S or null; $X_{11}$ is D, G, I, N, S or null; $X_{12}$ is D, E, G, K, I, N or null; $X_{13}$ is F, G, K, N, R, S, Y or null; $X_{14}$ is D, K, N, T or null; $X_{15}$ is A, D, G, L, N, S, T or Y; $X_{16}$ is L or V; $X_{17}$ is A, H, N, Q or S. In some embodiments, $X_1$ is G; $X_2$ is A; $X_3$ is N; $X_4$ is N; $X_5$ is null; $X_6$ is null; $X_7$ is null; $X_8$ is null; $X_9$ is null; $X_{10}$ is null; $X_{ii}$ is I; $X_{12}$ is G; $X_{13}$ is S; $X_{14}$ is K; $X_{15}$ is S; $X_{16}$ is V; $X_{17}$ is H.

In some embodiments, the antibody or antigen-binding fragment thereof contains a CDR-L1 comprising the amino acid sequence selected from any one of SEQ ID NOs: 26-36, 174-178, 302, 303, 380-392, 394-398, 589 or 601 according to Kabat numbering, Chothia numbering or AbM numbering. In some embodiments, the antibody or antigen-binding fragment thereof contains a CDR-L1 comprising the amino acid sequence selected from any one of SEQ ID NOs: 607 and 614. In some embodiments, the antibody or antigen-binding fragment thereof contains a CDR-L1 having the amino acid sequence of SEQ ID NO:589 or 601 according to Kabat numbering, Chothia numbering or AbM numbering. In any of such examples, the antibody or antigen-binding fragment thereof can contain a $V_L$ region sequence selected from any one of SEQ ID NOs: 116-127, 257-267, 326, 327, 534-550, 552-557, 610, 618, 775-777, and 833-849 in which the corresponding CDR-L1 sequence contained therein (e.g. corresponding to amino acid residues L24 to L34 by Kabat numbering) is replaced by the CDR-L1 sequence selected from any one of SEQ ID NOs: 26-36, 174-178, 302, 303, 380-392, 394-398, 589 or 601 according to Kabat numbering, Chothia numbering or AbM numbering.

In some embodiments, the $V_L$ region of an antibody or antigen-binding fragment thereof comprises a CDR-L1 contained within the $V_L$ region amino acid sequence selected from any one of SEQ ID NOs: 116-127, 257-267, 326, 327, 534-550, 552-557, 610, 618, 775-777, and 833-849. In some embodiments, the $V_L$ region of an antibody or antigen-binding fragment thereof comprises a CDR-L1 contained within the $V_L$ region amino acid sequence of SEQ ID NO:589, 601, 607 or 614.

In some embodiments, the $V_L$ region of the antibody provided herein (e.g., an anti-BCMA antibody) or antigen-binding fragment thereof is one that includes a light chain complementarity determining region 2 (CDR-L2) that contains the amino acid sequence of $X_1X_2X_3X_4X_5X_6X_7$ (SEQ ID NO:357), wherein $X_1$ is A, D, E, N, S, V or W; $X_2$ is A, D, N, S or V; $X_3$ is A, D, H, I, N or S; $X_4$ is D, K, N, Q, R or T; $X_5$ is L, R or V; $X_6$ is A, E, P or Q; and $X_7$ is A, D, S or T. In some embodiments, $X_1$ is D; $X_2$ is D; $X_3$ is D; $X_4$ is D; $X_5$ is R; $X_6$ is P; and $X_7$ is S.

In some embodiments, the antibody or antigen-binding fragment thereof contains a CDR-L2 comprising the amino acid sequence selected from any one of SEQ ID NOs:37-46, 179-183, 304, 305, 399-409, 411-414, 590 and 602 according to Kabat numbering, Chothia numbering or AbM numbering. In some embodiments, the antibody or antigen-binding fragment thereof contains a CDR-L2 comprising the amino acid sequence selected from any one of SEQ ID NOs: 608 and 615. In some embodiments, the antibody or antigen-binding fragment thereof contains a CDR-L2 having the amino acid sequence of SEQ ID NO:590 or SEQ ID NO: 602 according to Kabat numbering, Chothia numbering or AbM numbering. In any of such examples, the antibody or antigen-binding fragment thereof can contain a $V_L$ region sequence selected from any one of SEQ ID NOs: 116-127, 257-267, 326, 327, 534-550, 552-557, 610, 618, 775-777, and 833-849 in which the corresponding CDR-L2 sequence contained therein (e.g. corresponding to amino acid residues L50 to L56 by Kabat numbering) is replaced by the CDR-L2 sequence selected from any one of SEQ ID NOs: 37-46, 179-183, 304, 305, 399-409, 411-414, 590 and 602 according to Kabat numbering, Chothia numbering or AbM numbering, or with any of SEQ ID NOs: 608 and 615.

In some embodiments, the $V_L$ region of an antibody or antigen-binding fragment thereof comprises a CDR-L2 contained within the $V_L$ region amino acid sequence selected from any one of SEQ ID NOs: 116-127, 257-267, 326, 327, 534-550, 552-557, 610, 618, 775-777, and 833-849. In some embodiments, the $V_L$ region of an antibody or antigen-binding fragment thereof comprises a CDR-L2 contained within the $V_L$ region amino acid sequence of SEQ ID NO: 589, 601, 607 or 614.

In some embodiments, the antibody or antigen-binding fragment thereof contains a CDR-L1 that is or comprises the amino acid sequence selected from any one of SEQ ID NOs: 26-36, 174-178, 302, 303, 380-392, 394-398, 589 or 601 according to Kabat numbering, Chothia numbering or AbM numbering; a CDR-L2 that is or comprises the amino acid sequence selected from any one of SEQ ID NOs: 37-46, 179-183, 304, 305, 399-409, 411-414, 590 and 602 according to Kabat numbering, Chothia numbering or AbM numbering; and a CDR-L3 that is or comprises the amino acid sequence selected from any one of SEQ ID NOs: 47-58, 184-194, 306, 307, 415-427, 429-433, 591 and 603 according to Kabat numbering, Chothia numbering or AbM numbering.

In some embodiments, the $V_L$ region of an antibody or antigen-binding fragment thereof comprises a CDR-L1, CDR-L2, and/or CDR-L3 according to Kabat numbering. In some embodiments, the $V_L$ region of an antibody or antigen-binding fragment thereof comprises a CDR-L1, CDR-L2, and/or CDR-L3 according to Chothia numbering. In some embodiments, the $V_L$ region of an antibody or antigen-binding fragment thereof comprises a CDR-L1, CDR-L2, and/or CDR-L3 according to AbM numbering.

In some embodiments of the antibody or antigen-binding fragment thereof provided herein, the $V_L$ region comprises a CDR-L1, a CDR-L2, and a CDR-L3 selected from among: a CDR-L1, CDR-L2, and CDR-L3 comprising the amino acid sequence of SEQ ID NOs:26, 37, and 47, respectively; a CDR-L1, CDR-L2, and CDR-L3 comprising the amino acid sequence of SEQ ID NOs:27, 38, and 48, respectively; a CDR-L1, CDR-L2, and CDR-L3 comprising the amino acid sequence of SEQ ID NOs:28, 39, and 49, respectively; a CDR-L1, CDR-L2, and CDR-L3 comprising the amino acid sequence of SEQ ID NOs:29, 40, and 50, respectively; a CDR-L1, CDR-L2, and CDR-L3 comprising the amino acid sequence of SEQ ID NOs:30, 39, and 51, respectively; a CDR-L1, CDR-L2, and CDR-L3 comprising the amino acid sequence of SEQ ID NOs:31, 41, and 52, respectively; a CDR-L1, CDR-L2, and CDR-L3 comprising the amino acid sequence of SEQ ID NOs:32, 42, and 53, respectively; a CDR-L1, CDR-L2, and CDR-L3 comprising the amino acid sequence of SEQ ID NOs:30, 39, and 54, respectively; a CDR-L1, CDR-L2, and CDR-L3 comprising the amino acid sequence of SEQ ID NOs:33, 43, and 55, respectively; a CDR-L1, CDR-L2, and CDR-L3 comprising the amino acid sequence of SEQ ID NOs:34, 44, and 56, respectively; a CDR-L1, CDR-L2, and CDR-L3 comprising the amino acid sequence of SEQ ID NOs:35, 45, and 57, respectively; a CDR-L1, CDR-L2, and CDR-L3 comprising the amino acid sequence of SEQ ID NOs:36, 46, and 58, respectively; a CDR-L1, CDR-L2, and CDR-L3 comprising the amino acid sequence of SEQ ID NOs:174, 179, and 184, respectively; a CDR-L1, CDR-L2, and CDR-L3 comprising the amino acid sequence of SEQ ID NOs:174, 179, and 185, respectively; a CDR-L1, CDR-L2, and CDR-L3 comprising the amino acid sequence of SEQ ID NOs:174, 179, and 186, respectively; a CDR-L1, CDR-L2, and CDR-L3 comprising the amino acid sequence of SEQ ID NOs:174, 179, and 187, respectively; a CDR-L1, CDR-L2, and CDR-L3 comprising the amino acid sequence of SEQ ID NOs:175, 180, and 188, respectively; a CDR-L1, CDR-L2, and CDR-L3 comprising the amino acid sequence of SEQ ID NOs:174, 179, and 189, respectively; a CDR-L1, CDR-L2, and CDR-L3 comprising the amino acid sequence of SEQ ID NOs:176, 181, and 190, respectively; a CDR-L1, CDR-L2, and CDR-L3 comprising the amino acid sequence of SEQ ID NOs:177, 182, and 191, respectively; a CDR-L1, CDR-L2, and CDR-L3 comprising the amino acid sequence of SEQ ID NOs:174, 179, and 192, respectively; a CDR-L1, CDR-L2, and CDR-L3 comprising the amino acid sequence of SEQ ID NOs:178, 183, and 193, respectively; a CDR-L1, CDR-L2, and CDR-L3 comprising the amino acid sequence of SEQ ID NOs:178, 183, and 194, respectively; a CDR-L1, CDR-L2, and CDR-L3 comprising the amino acid sequence of SEQ ID NOs:30, 399, and 415, respectively; a CDR-L1, CDR-L2, and CDR-L3 comprising the amino acid sequence of SEQ ID NOs:380, 400, and 416, respectively; a CDR-L1, CDR-L2, and CDR-L3 comprising the amino acid sequence of SEQ ID NOs:33, 43, and 421, respectively; a CDR-L1, CDR-L2, and CDR-L3 comprising the amino acid sequence of SEQ ID NOs:381, 401, and 417, respectively; a CDR-L1, CDR-L2, and CDR-L3 comprising the amino acid sequence of SEQ ID NOs:382, 402, and 418, respectively; a CDR-L1, CDR-L2, and CDR-L3 comprising the amino acid sequence of SEQ ID NOs:383, 403, and 419, respectively; a CDR-L1, CDR-L2, and CDR-L3 comprising the amino acid sequence of SEQ ID NOs:384, 39, and 54, respectively; a CDR-L1, CDR-L2, and CDR-L3 comprising the amino acid sequence of SEQ ID NOs:385, 180, and 58, respectively; a CDR-L1, CDR-L2, and CDR-L3 comprising the amino acid sequence of SEQ ID NOs:175, 180, and 188, respectively; a CDR-L1, CDR-L2, and CDR-L3 comprising the amino acid sequence of SEQ ID NOs:386, 404, and 420, respectively; a CDR-L1, CDR-L2, and CDR-L3 comprising the amino acid sequence of SEQ ID NOs:387, 405, and 422, respectively; a CDR-L1, CDR-L2, and CDR-L3 comprising the amino acid sequence of SEQ ID NOs:388, 406, and 423, respectively; a CDR-L1, CDR-L2, and CDR-L3 comprising the amino acid sequence of SEQ ID NOs:388, 407, and 424, respectively; a CDR-L1, CDR-L2, and CDR-L3 comprising the amino acid sequence of SEQ ID NOs:389, 408, and 425, respectively; a CDR-L1, CDR-L2, and CDR-L3 comprising the amino acid sequence of SEQ ID NOs:390, 183, and 193, respectively; a CDR-L1, CDR-L2, and CDR-L3 comprising the amino acid sequence of SEQ ID NOs:391, 409, and 426, respectively; a CDR-L1, CDR-L2, and CDR-L3 comprising the amino acid sequence of SEQ ID NOs:392, 40, and 427, respectively; a CDR-L1, CDR-L2, and CDR-L3 comprising the amino acid sequence of SEQ ID NOs:394, 39, and 429, respectively; a CDR-L1, CDR-L2, and CDR-L3 comprising the amino acid sequence of SEQ ID NOs:395, 411, and 430, respectively; a CDR-L1, CDR-L2, and CDR-L3 comprising the amino acid sequence of SEQ ID NOs:396, 412, and 431, respectively; a CDR-L1, CDR-L2, and CDR-L3 comprising the amino acid sequence of SEQ ID NOs:396, 412, and 58, respectively; a CDR-L1, CDR-L2, and CDR-L3 comprising the amino acid sequence of SEQ ID NOs:397, 413, and 432, respectively; a CDR-L1, CDR-L2, and CDR-L3 comprising the amino acid sequence of SEQ ID NOs:398, 414, and 433, respectively; a CDR-L1, CDR-L2, and CDR-L3 comprising the amino acid sequence of SEQ ID NOs:302, 304, and 306, respectively; a CDR-L1, CDR-L2, and CDR-L3 comprising the amino acid sequence of SEQ ID NOs:303, 305, and 307, respectively; a CDR-L1, CDR-L2, and CDR-L3 comprising the amino acid sequence of SEQ ID NOs:589, 590, and 591, respectively; a CDR-L1, CDR-L2, and CDR-L3 comprising the amino acid sequence of SEQ ID NOs:607, 608, and 591, respectively; a CDR-L1, CDR-L2, and CDR-L3 comprising the amino acid sequence of SEQ ID NOs: 601, 602, and 603, respectively; a CDR-L1, CDR-L2, and CDR-L3 comprising the amino acid sequence of SEQ ID NOs:614, 615, and 603, respectively. In some embodiments of the antibody or antigen-binding fragment thereof provided herein, the $V_L$ region comprises a CDR-L1, CDR-L2, and CDR-L3 comprising the amino acid sequences of SEQ ID NOs:589, 590, and 591, respectively; SEQ ID NOs:607, 608, and 591, respectively; SEQ ID NOs: 601, 602, and 603, respectively; or SEQ ID NOs:614, 615, and 603, respectively.

For example, the antibody or antigen-binding fragment thereof provided herein comprises an $V_L$ region comprising a CDR-L1, CDR-L2, and CDR-L3 comprising the amino acid sequence selected from among: SEQ ID NOs:26, 37, and 47; SEQ ID NOs:27, 38, and 48; SEQ ID NOs:28, 39, and 49; SEQ ID NOs:29, 40, and 50; SEQ ID NOs:30, 39, and 51; SEQ ID NOs:31, 41, and 52; SEQ ID NOs:32, 42, and 53; SEQ ID NOs:30, 39, and 54; SEQ ID NOs:33, 43, and 55; SEQ ID NOs:34, 44, and 56; SEQ ID NOs:35, 45, and 57; SEQ ID NOs:36, 46, and 58; SEQ ID NOs:174, 179, and 184; SEQ ID NOs:174, 179, and 185; SEQ ID NOs:174, 179, and 186; SEQ ID NOs:174, 179, and 187; SEQ ID NOs:175, 180, and 188; SEQ ID NOs:174, 179, and 189; SEQ ID NOs:176, 181, and 190; SEQ ID NOs:177, 182, and 191; SEQ ID NOs:174, 179, and 192; SEQ ID NOs:178, 183, and 193; SEQ ID NOs:178, 183, and 194; SEQ ID NOs:30, 399, and 415; SEQ ID NOs:380, 400, and 416; SEQ ID NOs:33, 43, and 421; SEQ ID NOs:381, 401, and 417; SEQ ID NOs:382, 402, and 418; SEQ ID NOs:383, 403, and 419; SEQ ID NOs:384, 39, and 54; SEQ ID NOs:385, 180, and 58; SEQ ID NOs:175, 180, and 188; SEQ ID NOs:386, 404, and 420; SEQ ID NOs:387, 405, and 422; SEQ ID NOs:388, 406, and 423; SEQ ID NOs:388, 407, and 424; SEQ ID NOs:389, 408, and 425; SEQ ID NOs:390, 183, and 193; SEQ ID NOs:391, 409, and 426; SEQ ID NOs:392, 40, and 427; SEQ ID NOs:394, 39, and 429; SEQ ID NOs:395, 411, and 430; SEQ ID NOs:396, 412, and 431; SEQ ID NOs:396, 412, and 58; SEQ ID NOs:397, 413, and 432; SEQ ID NOs:398, 414, and 433; SEQ ID NOs:589, 590, and 591; SEQ ID NOs:607, 608, and 591; SEQ ID NOs: 601, 602, and 603; or SEQ ID NOs:614, 615, and 603, respectively.

In some embodiments, the antibody or antigen-binding fragment thereof contains a CDR-L1, CDR-L2, and CDR-L3, respectively, contained within the $V_L$ region amino acid sequence selected from any one of SEQ ID NOs: 116-127, 257-267, 326, 327, 534-550, 552-557, 610, 618, 775-777, and 833-849. In some embodiments, the antibody contains a CDR-L1, CDR-L2, and CDR-L3, respectively, contained within the $V_L$ region amino acid sequence selected of SEQ ID NO: 610 or SEQ ID NO: 618.

In some embodiments, the antibody or antigen-binding fragment thereof comprises a $V_L$ region that comprises a CDR-L1, CDR-L2, and CDR-L3 comprising the amino acid sequence of SEQ ID NOS:601, 602, and 603, respectively; or SEQ ID NOS: 614, 615, and 603, respectively.

In some embodiments of the antibody or antigen-binding fragment thereof provided herein, the $V_L$ region comprises any of the CDR-L1, CDR-L2 and CDR-L3 as described and comprises a framework region 1 (FR1), a FR2, a FR3 and/or a FR4 having at least 90%, 91%, 92%, 93%, 94%, 95%, 96%, 97%, 98%, or 99% sequence identity, respectively, to a FR1, a FR2, a FR3 and/or a FR4 contained within the $V_L$ region amino acid sequence selected from any one of SEQ ID NOs: 116-127, 257-267, 326, 327, 534-550, 552-557, 610, 618, 775-777, and 833-849. For example, the anti-BCMA antibody or antigen-binding fragment thereof can comprise a CDR-L1, CDR-L2 and CDR-L3, respectively, contained within the $V_L$ region amino acid sequence selected from any one of SEQ ID NOs: 116-127, 257-267, 326, 327, 534-550, 552-557, 610, 618, 775-777, and 833-849, and a framework region (e.g., a FR1, a FR2, a FR3 and/or a FR4) that contains at least 90%, 91%, 92%, 93%, 94%, 95%, 96%, 97%, 98%, 99% sequence identity to a framework region (e.g., a FR1, a FR2, a FR3 and/or a FR4) contained within the $V_L$ region amino acid sequence selected from any one of SEQ ID NOs: 116-127, 257-267, 326, 327, 534-550, 552-557, 610, 618, 775-777, and 833-849. In some embodiments, the $V_L$ region comprises a FR1, a FR2, a FR3 and/or a FR4 selected from a FR1 comprising the amino acid sequence selected from any one of SEQ ID NOs:72-82, 221-227, 316, 317, 446-459 and 461-466; a FR2 comprising the amino acid sequence selected from any one of SEQ ID NOs:83-92, 228-232, 318, 319, 467-477 and 479-482; a FR3 comprising the amino acid sequence selected from any one of SEQ ID NOs:93-101, 233-242, 320, 321, 483-495 and 497-501; and/or a FR4 comprising the amino acid sequence selected from any one of SEQ ID NOs:102-109, 243-246, 322, 323, 502-506 and 508. In some embodiments, the $V_L$ region comprises a FR1 comprising the amino acid sequence of SEQ ID NO:79, a FR2 comprising the amino acid sequence of SEQ ID NO:89, a FR3 comprising the amino acid sequence of SEQ ID NO:98, and/or a FR4 comprising the amino acid sequence of SEQ ID NO:108.

In some embodiments, the antibody or antigen-binding fragment thereof comprises a $V_L$ region comprising an amino acid sequence selected from any one of SEQ ID NOs: 116-127, 257-267, 326, 327, 534-550, 552-557, 610, 618, 775-777, and 833-849. In some embodiments, the antibody or antigen-binding fragment thereof contains a $V_L$ region comprises the amino acid sequence of SEQ ID NO: 610 or SEQ ID NO: 618.

Also provided are antibodies having sequences at least at or about at least 90%, 91%, 92%, 93%, 94%, 95%, 96%, 97%, 98%, or 99% identical to such sequences.

In some embodiments, the $V_H$ region of the antibody or fragment comprises the amino acid sequence selected from any one of SEQ ID NOs: 110-115, 247-256, 324, 325, 518-531, 533, 609, 617, 772-774, and 814-832 and the $V_L$ region of the antibody or fragment comprises the amino acid sequence selected from any one of SEQ ID NOs: 116-127, 257-267, 326, 327, 534-550, 552-557, 610, 618, 775-777, and 833-849.

Also provided are antibodies and antigen-binding fragments thereof having sequences at least at or about at least 90%, 91%, 92%, 93%, 94%, 95%, 96%, 97%, 98%, or 99% identical to such sequences. For example, provided herein is an antibody or antigen-binding fragment containing a $V_L$ region comprising an amino acid sequence having at least 90%, 91%, 92%, 93%, 94%, 95%, 96%, 97%, 98%, or 99% sequence identity to a $V_L$ region amino acid sequence selected from any one of SEQ ID NOs: 116-127, 257-267, 326, 327, 534-550, 552-557, 610, 618, 775-777, and 833-849 and/or comprising an amino acid sequence having at least 90%, 91%, 92%, 93%, 94%, 95%, 96%, 97%, 98%, or 99% sequence identity to a $V_H$ region amino acid sequence selected from any one of SEQ ID NOs: 110-115, 247-256, 324, 325, 518-531, 533, 609, 617, 772-774, and 814-832. In some embodiments, the antibody or antigen-binding fragment contains a $V_L$ region comprising the amino acid sequence selected from any one of SEQ ID NOs: 116-127, 257-267, 326, 327, 534-550, 552-557, 610, 618, 775-777, and 833-849 and a $V_H$ region the amino acid sequence selected from any one of SEQ ID NOs: 110-115, 247-256, 324, 325, 518-531, 533, 609, 617, 772-774, and 814-832.

In some embodiments, the $V_H$ region is or comprises an amino acid sequence having at least 90%, 91%, 92%, 93%, 94%, 95%, 96%, 97%, 98% or 99% sequence identity to the $V_H$ region sequence of any of SEQ ID NOs:617, 110-115, 247-256, 324, 325, 518-531, 533, 609, 772-774, or 814-832; and the $V_L$ region is or comprises an amino acid sequence having at least 90%, 91%, 92%, 93%, 94%, 95%, 96%, 97%, 98%, or 99% sequence identity to the $V_L$ region sequence of any of SEQ ID NOs: 618, 116-127, 257-267, 326, 327, 534-550, 552-557, 610, 775-777, or 833-849.

In some embodiments, the $V_H$ region and the $V_L$ regions comprise the sequence of SEQ ID NOs:617 and 618, respectively, or a sequence of amino acids having at least 90% identity thereto; the $V_H$ region and the $V_L$ regions comprise the sequence of SEQ ID NOs:110 and 116, respectively, or a sequence of amino acids having at least 90% identity thereto; the $V_H$ region and the $V_L$ regions comprise the sequence of SEQ ID NOs:111 and 117, respectively, or a sequence of amino acids having at least 90% identity thereto; the $V_H$ region and the $V_L$ regions comprise the sequence of SEQ ID NOs:110 and 118, respectively, or a sequence of amino acids having at least 90% identity thereto; the $V_H$ region and the $V_L$ regions comprise the sequence of SEQ ID NOs:110 and 119, respectively, or a sequence of amino acids having at least 90% identity thereto; the $V_H$ region and the $V_L$ regions comprise the sequence of SEQ ID NOs:110 and 120, respectively, or a sequence of amino acids having at least 90% identity thereto; the $V_H$ region and the $V_L$ regions comprise the sequence of SEQ ID NOs:110 and 121, respectively, or a sequence of amino acids having at least 90% identity thereto; the $V_H$ region and the $V_L$ regions comprise the sequence of SEQ ID NOs:110 and 122, respectively, or a sequence of amino acids having at least 90% identity thereto; the $V_H$ region and the $V_L$ regions comprise the sequence of SEQ ID NOs:110 and 123, respectively, or a sequence of amino acids having at least 90% identity thereto; the $V_H$ region and the $V_L$ regions comprise the sequence of SEQ ID NOs:112 and 124, respectively, or a sequence of amino acids having at least 90% identity thereto; the $V_H$ region and the $V_L$ regions comprise the sequence of SEQ ID NOs:113 and 125, respectively, or a sequence of amino acids having at least 90% identity thereto; the $V_H$ region and the $V_L$ regions comprise the sequence of SEQ ID NOs:114 and 126, respectively, or a sequence of amino acids having at least 90% identity thereto; the $V_H$ region and the $V_L$ regions comprise the sequence of SEQ ID NOs:115 and 127, respectively, or a sequence of amino acids having at least 90% identity thereto; the $V_H$ region and the $V_L$ regions comprise the sequence of SEQ ID NOs:247 and 257, respectively, or a sequence of amino acids having at least 90% identity thereto; the $V_H$ region and the $V_L$ regions comprise the sequence of SEQ ID NOs:248 and 258, respectively, or a sequence of amino acids having at least 90% identity thereto; the $V_H$ region and the $V_L$ regions comprise the sequence of SEQ ID NOs:249 and 259, respectively, or a sequence of amino acids having at least 90% identity thereto; the $V_H$ region and the $V_L$ regions comprise the sequence of SEQ ID NOs:250 and 260, respectively, or a sequence of amino acids having at least 90% identity thereto; the $V_H$ region and the $V_L$ regions comprise the sequence of SEQ ID NOs:251 and 261, respectively, or a sequence of amino acids having at least 90% identity thereto; the $V_H$ region and the $V_L$ regions comprise the sequence of SEQ ID NOs:252 and 262, respectively, or a sequence of amino acids having at least 90% identity thereto; the $V_H$ region and the $V_L$ regions comprise the sequence of SEQ ID NOs:253 and 263, respectively, or a sequence of amino acids having at least 90% identity thereto; the $V_H$ region and the $V_L$ regions comprise the sequence of SEQ ID NOs:254 and 264, respectively, or a sequence of amino acids having at least 90% identity thereto; the $V_H$ region and the $V_L$ regions comprise the sequence of SEQ ID NOs:255 and 265, respectively, or a sequence of amino acids having at least 90% identity thereto; the $V_H$ region and the $V_L$ regions comprise the sequence of SEQ ID NOs:256 and 266, respectively, or a sequence of amino acids having at least 90% identity thereto; the $V_H$ region and the $V_L$ regions comprise the sequence of SEQ ID NOs:256 and 267, respectively, or a sequence of amino acids having at least 90% identity thereto; the $V_H$ region and the $V_L$ regions comprise the sequence of SEQ ID NOs:518 and 534, respectively, or a sequence of amino acids having at least 90% identity thereto; the $V_H$ region and the $V_L$ regions comprise the sequence of SEQ ID NOs:519 and 535, respectively, or a sequence of amino acids having at least 90% identity thereto; the $V_H$ region and the $V_L$ regions comprise the sequence of SEQ ID NOs:115 and 536, respectively, or a sequence of amino acids having at least 90% identity thereto; the $V_H$ region and the $V_L$ regions comprise the sequence of SEQ ID NOs:520 and 264, respectively, or a sequence of amino acids having at least 90% identity thereto; the $V_H$ region and the $V_L$ regions comprise the sequence of SEQ ID NOs:521 and 537, respectively, or a sequence of amino acids having at least 90% identity thereto; the $V_H$ region and the $V_L$ regions comprise the sequence of SEQ ID NOs:522 and 538, respectively, or a sequence of amino acids having at least 90% identity thereto; the $V_H$ region and the $V_L$ regions comprise the sequence of SEQ ID NOs:523 and 539, respectively, or a sequence of amino acids having at least 90% identity thereto; the $V_H$ region and the $V_L$ regions comprise the sequence of SEQ ID NOs:519 and 540, respectively, or a sequence of amino acids having at least 90% identity thereto; the $V_H$ region and the $V_L$ regions comprise the sequence of SEQ ID NOs:524 and 541, respectively, or a sequence of amino acids having at least 90% identity thereto; the $V_H$ region and the $V_L$ regions comprise the sequence of SEQ ID NOs:525 and 261, respectively, or a sequence of amino acids having at least 90% identity thereto; the $V_H$ region and the $V_L$ regions comprise the sequence of SEQ ID NOs:526 and 542, respectively, or a sequence of amino acids having at least 90% identity thereto; the $V_H$ region and the $V_L$ regions comprise the sequence of SEQ ID NOs:527 and 543, respectively, or a sequence of amino acids having at least 90% identity thereto; the $V_H$ region and the $V_L$ regions comprise the sequence of SEQ ID NOs:528 and 544, respectively, or a sequence of amino acids having at least 90% identity thereto; the $V_H$ region and the $V_L$ regions comprise the sequence of SEQ ID NOs:529 and 545, respectively, or a sequence of amino acids having at least 90% identity thereto; the $V_H$ region and the $V_L$ regions comprise the sequence of SEQ ID NOs:528 and 546, respectively, or a sequence of amino acids having at least 90% identity thereto; the $V_H$ region and the $V_L$ regions comprise the sequence of SEQ ID NOs:522 and 547, respectively, or a sequence of amino acids having at least 90% identity thereto; the $V_H$ region and the $V_L$ regions comprise the sequence of SEQ ID NOs:256 and 548, respectively, or a sequence of amino acids having at least 90% identity thereto; the $V_H$ region and the $V_L$ regions comprise the sequence of SEQ ID NOs:530 and 549, respectively, or a sequence of amino acids having at least 90% identity thereto; the $V_H$ region and the $V_L$ regions comprise the sequence of SEQ ID NOs:531 and 550, respectively, or a sequence of amino acids having at least 90% identity thereto; the $V_H$ region and the $V_L$ regions comprise the sequence of SEQ ID NOs:519 and 552, respectively, or a sequence of amino acids having at least 90% identity thereto; the $V_H$ region and the $V_L$ regions comprise the sequence of SEQ ID NOs:110 and 553, respectively, or a sequence of amino acids having at least 90% identity thereto; the $V_H$ region and the $V_L$ regions comprise the sequence of SEQ ID NOs:533 and 554, respectively, or a sequence of amino acids having at least 90% identity thereto; the $V_H$ region and the $V_L$ regions comprise the sequence of SEQ ID NOs:115 and 555, respectively, or a sequence of amino acids having at least 90% identity thereto; the $V_H$ region and the $V_L$ regions comprise the sequence of SEQ ID NOs:524 and 556, respectively, or a sequence of amino acids having at least 90% identity thereto; the $V_H$ region and the $V_L$ regions comprise the sequence of SEQ ID NOs:519 and 557, respectively, or a sequence of amino acids having at least 90% identity thereto; the $V_H$ region and the $V_L$ regions comprise the sequence of SEQ ID NOs:324 and 326, respectively, or a sequence of amino acids having at least 90% identity thereto; the $V_H$ region and the $V_L$ regions comprise the sequence of SEQ ID NOs:325 and 327, respectively, or a sequence of amino acids having at least 90% identity thereto; the $V_H$ region and the $V_L$ regions comprise the sequence of SEQ ID NOs:609 and 610, respectively, or a sequence of amino acids having at least 90% identity thereto; the $V_H$ region and the $V_L$ regions comprise the sequence of SEQ ID NOs:772 and 775, respectively, or a sequence of amino acids having at least 90% identity thereto; the $V_H$ region and the $V_L$ regions comprise the sequence of SEQ ID NOs:773 and 776, respectively, or a sequence of amino acids having at least 90% identity thereto; the $V_H$ region and the $V_L$ regions comprise the sequence of SEQ ID NOs:774 and 777, respectively, or a sequence of amino acids having at least 90% identity thereto; the $V_H$ region and the $V_L$ regions comprise the sequence of SEQ ID NOs:815 and 833, respectively, or a sequence of amino acids having at least 90% identity thereto; the $V_H$ region and the $V_L$ regions comprise the sequence of SEQ ID NOs:816 and 834, respectively, or a sequence of amino acids having at least 90% identity thereto; the $V_H$ region and the $V_L$ regions comprise the sequence of SEQ ID NOs:817 and 835, respectively, or a sequence of amino acids having at least 90% identity thereto; the $V_H$ region and the $V_L$ regions comprise the sequence of SEQ ID NOs:818 and 836, respectively, or a sequence of amino acids having at least 90% identity thereto; the $V_H$ region and the $V_L$ regions comprise the sequence of SEQ ID NOs:819 and 837, respectively, or a sequence of amino acids having at least 90% identity thereto; the $V_H$ region and the $V_L$ regions comprise the sequence of SEQ ID NOs:820 and 838, respectively, or a sequence of amino acids having at least 90% identity thereto; the $V_H$ region and the $V_L$ regions comprise the sequence of SEQ ID NOs:821 and 839, respectively, or a sequence of amino acids having at least 90% identity thereto; the $V_H$ region and the $V_L$ regions comprise the sequence of SEQ ID NOs:822 and 840, respectively, or a sequence of amino acids having at least 90% identity thereto; the $V_H$ region and the $V_L$ regions comprise the sequence of SEQ ID NOs:823 and 841, respectively, or a sequence of amino acids having at least 90% identity thereto; the $V_H$ region and the $V_L$ regions comprise the sequence of SEQ ID NOs:824 and 842, respectively, or a sequence of amino acids having at least 90% identity thereto; the $V_H$ region and the $V_L$ regions comprise the sequence of SEQ ID NOs:825 and 843, respectively, or a sequence of amino acids having at least 90% identity thereto; the $V_H$ region and the $V_L$ regions comprise the sequence of SEQ ID NOs:826 and 844, respectively, or a sequence of amino acids having at least 90% identity thereto; the $V_H$ region and the $V_L$ regions comprise the sequence of SEQ ID NOs:827 and 845, respectively, or a sequence of amino acids having at least 90% identity thereto; the $V_H$ region and the $V_L$ regions comprise the sequence of SEQ ID NOs:828 and 846, respectively, or a sequence of amino acids having at least 90% identity thereto; the $V_H$ region and the $V_L$ regions comprise the sequence of SEQ ID NOs:829 and 847, respectively, or a sequence of amino acids having at least 90% identity thereto; the $V_H$ region and the $V_L$ regions comprise the sequence of SEQ ID NOs:830 and 847, respectively, or a sequence of amino acids having at least 90% identity thereto; the $V_H$ region and the $V_L$ regions comprise the sequence of SEQ ID NOs:831 and 848, respectively, or a sequence of amino acids having at least 90% identity thereto; or the $V_H$ region and the $V_L$ regions comprise the sequence of SEQ ID NOs:832 and 849, respectively, or a sequence of amino acids having at least 90% identity thereto.

In some embodiments, the $V_H$ region of the antibody or antigen-binding fragment thereof comprises a CDR-H1, a CDR-H2, a CDR-H3, respectively, comprising the amino acid sequences of CDR-H1, CDR-H2, and CDR-H3 contained within the $V_H$ region amino acid sequence selected from any one of SEQ ID NOs: 617, 110-115, 247-256, 324, 325, 518-531, 533, 609, 772-774, and 814-832; and comprises a CDR-L1, a CDR-L2, a CDR-L3, respectively, comprising the amino acid sequences of CDR-L1, CDR-L2, and CDR-L3, respectively contained within the $V_L$ region amino acid sequence selected from any one of SEQ ID NOs: 618, 116-127, 257-267, 326, 327, 534-550, 552-557, 610, 775-777, and 833-849.

In some of any embodiments, the $V_H$ is or comprises a CDR-H1, CDR-H2 and CDR-H3 contained within the $V_H$ sequence of SEQ ID NO: 617; and the $V_L$ is or comprises a CDR-L1, CDR-L2 and CDR-L3 contained within the $V_L$ sequence of SEQ ID NO: 618; the $V_H$ is or comprises a CDR-H1, CDR-H2 and CDR-H3 contained within the $V_H$ sequence of SEQ ID NO: 256; and the $V_L$ is or comprises a CDR-L1, CDR-L2 and CDR-L3 contained within the $V_L$ sequence of SEQ ID NO: 267; the $V_H$ is or comprises a CDR-H1, CDR-H2 and CDR-H3 contained within the $V_H$ sequence of SEQ ID NO: 519; and the $V_L$ is or comprises a CDR-L1, CDR-L2 and CDR-L3 contained within the $V_L$ sequence of SEQ ID NO: 535; the $V_H$ is or comprises a CDR-H1, CDR-H2 and CDR-H3 contained within the $V_H$ sequence of SEQ ID NO:115; and the $V_L$ is or comprises a CDR-L1, CDR-L2 and CDR-L3 contained within the $V_L$ sequence of SEQ ID NO: 536; or the $V_H$ is or comprises a CDR-H1, CDR-H2 and CDR-H3 contained within the $V_H$ sequence of SEQ ID NO: 609; and the $V_L$ is or comprises a CDR-L1, CDR-L2 and CDR-L3 contained within the $V_L$ sequence of SEQ ID NO: 610. In some of any embodiments, the $V_H$ region comprises a CDR-H1, CDR-H2 and CDR-H3 contained within the $V_H$ region amino acid sequence set forth in SEQ ID NO: 617; and the $V_L$ region comprises a CDR-L1, CDR-L2 and CDR-L3 contained within the $V_L$ region amino acid sequence set forth in SEQ ID NO: 618; the $V_H$ region comprises a CDR-H1, CDR-H2 and CDR-H3 contained within the $V_H$ region amino acid sequence set forth in SEQ ID NO: 256; and the $V_L$ region comprises a CDR-L1, CDR-L2 and CDR-L3 contained within the $V_L$ region amino acid sequence set forth in SEQ ID NO: 267; the $V_H$ region comprises a CDR-H1, CDR-H2 and CDR-H3 contained within the $V_H$ region amino acid sequence set forth in SEQ ID NO: 519; and the $V_L$ region comprises a CDR-L1, CDR-L2 and CDR-L3 contained within the $V_L$ region amino acid sequence set forth in SEQ ID NO: 535; the $V_H$ region comprises a CDR-H1, CDR-H2 and CDR-H3 contained within the $V_H$ region amino acid sequence set forth in SEQ ID NO:115; and the $V_L$ region comprises a CDR-L1, CDR-L2 and CDR-L3 contained within the $V_L$ region amino acid sequence set forth in SEQ ID NO: 536; or the $V_H$ region comprises a CDR-H1, CDR-H2 and CDR-H3 contained within the $V_H$ region amino acid sequence set forth in SEQ ID NO: 609; and the V$_L$ region comprises a CDR-L1, CDR-L2 and CDR-L3 contained within the V$_L$ region amino acid sequence set forth in SEQ ID NO: 610.

In some embodiments, the V$_H$ region is or comprises (a) a CDR-H1 comprising the sequence selected from any one of SEQ ID NOs: 593, 611, 1-3, 140-144, 288, 289, 294, 295, 507, 532, 596, or 604; (b) a CDR-H2 comprising the sequence selected from any one of SEQ ID NOs: 594, 612, 4-6, 145-148, 290, 291, 296, 297, 372-374, 513, 551, 597, or 605; and (c) a CDR-H3 comprising the sequence selected from any one of SEQ ID NOs: 595, 613, 7-11, 149-157, 279-287, 292, 293, 376-378, 517, or 606; and the V$_L$ region is or comprises (a) a CDR-L1 comprising the sequence selected from any one of SEQ ID NOs: 601, 614, 26-36, 174-178, 302, 303, 380-392, 394-398, 589, or 607; (b) a CDR-L2 comprising the sequence selected from any one of SEQ ID NOs: 602, 615, 37-46, 179-183, 304, 305, 399-409, 411-414, 590, or 608; and (c) a CDR-L3 comprising the sequence selected from any one of SEQ ID NOs: 603, 47-58, 184-194, 306, 307, 415-427, 429-433, or 591.

In some embodiments, the V$_H$ region comprises a CDR-H1, CDR-H2, and CDR-H3 comprising the sequence of SEQ ID NOS:593, 594, and 595, respectively, and the V$_L$ region comprises a CDR-L1, CDR-L2, and CDR-L3 comprising the sequence of SEQ ID NOS:601, 602, and 603, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:26, 37, and 47, respectively; the V$_H$ region comprises a CDR-H1, CDR-H2, and CDR-H3 comprising the sequence of SEQ ID NOS:2, 5, and 8, respectively, and the V$_L$ region comprises a CDR-L1, CDR-L2, and CDR-L3 comprising the sequence of SEQ ID NOS:27, 38, and 48, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:28, 39, and 49, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:29, 40, and 50, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:30, 39, and 51, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:31, 41, and 52, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:32, 42, and 53, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:30, 39, and 54, respectively; the V$_H$ region comprises a CDR-H1, CDR-H2, and CDR-H3 comprising the sequence of SEQ ID NOS:2, 5, and 9, respectively, and the V$_L$ region comprises a CDR-L1, CDR-L2, and CDR-L3 comprising the sequence of SEQ ID NOS:33, 43, and 55, respectively; the V$_H$ region comprises a CDR-H1, CDR-H2, and CDR-H3 comprising the sequence of SEQ ID NOS:2, 5, and 10, respectively, and the V$_L$ region comprises a CDR-L1, CDR-L2, and CDR-L3 comprising the sequence of SEQ ID NOS:34, 44, and 56, respectively; the V$_H$ region comprises a CDR-H1, CDR-H2, and CDR-H3 comprising the sequence of SEQ ID NOS:3, 6, and 11, respectively, and the V$_L$ region comprises a CDR-L1, CDR-L2, and CDR-L3 comprising the sequence of SEQ ID NOS:35, 45, and 57, respectively; the V$_H$ region comprises a CDR-H1, CDR-H2, and CDR-H3 comprising the sequence of SEQ ID NOS:2, 5, and 10, respectively, and the V$_L$ region comprises a CDR-L1, CDR-L2, and CDR-L3 comprising the sequence of SEQ ID NOS:36, 46, and 58, respectively; the V$_H$ region comprises a CDR-H1, CDR-H2, and CDR-H3 comprising the sequence of SEQ ID NOS:140, 145, and 149, respectively, and the V$_L$ region comprises a CDR-L1, CDR-L2, and CDR-L3 comprising the sequence of SEQ ID NOS:174, 179, and 184, respectively; the V$_H$ region comprises a CDR-H1, CDR-H2, and CDR-H3 comprising the sequence of SEQ ID NOS:141, 145, and 149, respectively, and the V$_L$ region comprises a CDR-L1, CDR-L2, and CDR-L3 comprising the sequence of SEQ ID NOS:174, 179, and 185, respectively; the V$_H$ region comprises a CDR-H1, CDR-H2, and CDR-H3 comprising the sequence of SEQ ID NOS:141, 145, and 150, respectively, and the V$_L$ region comprises a CDR-L1, CDR-L2, and CDR-L3 comprising the sequence of SEQ ID NOS:174, 179, and 186, respectively; the V$_H$ region comprises a CDR-H1, CDR-H2, and CDR-H3 comprising the sequence of SEQ ID NOS:142, 146, and 151, respectively, and the V$_L$ region comprises a CDR-L1, CDR-L2, and CDR-L3 comprising the sequence of SEQ ID NOS:174, 179, and 187, respectively; the V$_H$ region comprises a CDR-H1, CDR-H2, and CDR-H3 comprising the sequence of SEQ ID NOS:2, 5, and 152, respectively, and the V$_L$ region comprises a CDR-L1, CDR-L2, and CDR-L3 comprising the sequence of SEQ ID NOS:175, 180, and 188, respectively; the V$_H$ region comprises a CDR-H1, CDR-H2, and CDR-H3 comprising the sequence of SEQ ID NOS:143, 147, and 153, respectively, and the V$_L$ region comprises a CDR-L1, CDR-L2, and CDR-L3 comprising the sequence of SEQ ID NOS:174, 179, and 189, respectively; the V$_H$ region comprises a CDR-H1, CDR-H2, and CDR-H3 comprising the sequence of SEQ ID NOS:144, 148, and 154, respectively, and the V$_L$ region comprises a CDR-L1, CDR-L2, and CDR-L3 comprising the sequence of SEQ ID NOS:176, 181, and 190, respectively; the V$_H$ region comprises a CDR-H1, CDR-H2, and CDR-H3 comprising the sequence of SEQ ID NOS:3, 6, and 155, respectively, and the V$_L$ region comprises a CDR-L1, CDR-L2, and CDR-L3 comprising the sequence of SEQ ID NOS:177, 182, and 191, respectively; the V$_H$ region comprises a CDR-H1, CDR-H2, and CDR-H3 comprising the sequence of SEQ ID NOS:2, 5, and 156, respectively, and the V$_L$ region comprises a CDR-L1, CDR-L2, and CDR-L3 comprising the sequence of SEQ ID NOS:174, 179, and 192, respectively; the V$_H$ region comprises a CDR-H1, CDR-H2, and CDR-H3 comprising the sequence of SEQ ID NOS:2, 5, and 157, respectively, and the V$_L$ region comprises a CDR-L1, CDR-L2, and CDR-L3 comprising the sequence of SEQ ID NOS:178, 183, and 193, respectively; the V$_H$ region comprises a CDR-H1, CDR-H2, and CDR-H3 comprising the sequence of SEQ ID NOS:2, 5, and 157, respectively, and the V$_L$ region comprises a CDR-L1, CDR-L2, and CDR-L3 comprising the sequence of SEQ ID NOS:178, 183, and 194, respectively; the V$_H$ region comprises a CDR-H1, CDR-H2, and CDR-H3 comprising the sequence of SEQ ID NOS:2, 6, and 376, respectively, and the V$_L$ region comprises a CDR-L1, CDR-L2, and CDR-L3 comprising the sequence of SEQ ID NOS:30, 399, and 415, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:380, 400, and 416, respectively; the V$_H$ region comprises a CDR-H1, CDR-H2, and CDR-H3 comprising the sequence of SEQ ID NOS:2, 5, and 10, respectively, and the V$_L$ region comprises a CDR-L1, CDR-L2, and CDR-L3 comprising the sequence of SEQ ID NOS:33, 43, and 421, respectively; the V$_H$ region comprises a CDR-H1, CDR-H2, and CDR-H3 comprising the sequence of SEQ ID NOS:3, 6, and 155, respectively, and the V$_{L\ region\ comprises\ a\ CDR-L}$1, CDR-L2, and CDR-L3 comprising the sequence of SEQ ID NOS:177, 182, and 191, respectively; the V$_H$ region comprises a CDR-H1, CDR-H2, and CDR-H3 comprising the sequence of SEQ ID NOS:3, 372, and 376, respectively, and the V$_L$ region comprises a CDR-L1, CDR-L2, and CDR-L3 comprising the sequence of SEQ ID NOS:381, 401, and 417, respectively; the V$_H$ region comprises a CDR-H1, CDR-H2, and CDR-H3 comprising the sequence of SEQ ID NOS:3, 6, and 376, respectively, and the V$_L$ region comprises a CDR-L1, CDR-L2, and CDR-L3 comprising the sequence of SEQ ID NOS:382, 402, and 418, respectively; the V$_H$ region comprises a CDR-H1, CDR-H2, and CDR-H3 comprising the sequence of SEQ ID NOS:3, 6, and 377, respectively, and the V$_L$ region comprises a CDR-L1, CDR-L2, and CDR-L3 comprising the sequence of SEQ ID NOS:383, 403, and 419, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:384, 39, and 54, respectively; the V$_H$ region comprises a CDR-H1, CDR-H2, and CDR-H3 comprising the sequence of SEQ ID NOS:2, 5, and 10, respectively, and the V$_L$ region comprises a CDR-L1, CDR-L2, and CDR-L3 comprising the sequence of SEQ ID NOS:385, 180, and 58, respectively; the V$_H$ region comprises a CDR-H1, CDR-H2, and CDR-H3 comprising the sequence of SEQ ID NOS:2, 373, and 152, respectively, and the V$_L$ region comprises a CDR-L1, CDR-L2, and CDR-L3 comprising the sequence of SEQ ID NOS:175, 180, and 188, respectively; the V$_H$ region comprises a CDR-H1, CDR-H2, and CDR-H3 comprising the sequence of SEQ ID NOS:3, 6, and 11, respectively, and the V$_L$ region comprises a CDR-L1, CDR-L2, and CDR-L3 comprising the sequence of SEQ ID NOS:386, 404, and 420, respectively; the V$_H$ region comprises a CDR-H1, CDR-H2, and CDR-H3 comprising the sequence of SEQ ID NOS:2, 5, and 378, respectively, and the V$_L$ region comprises a CDR-L1, CDR-L2, and CDR-L3 comprising the sequence of SEQ ID NOS:33, 43, and 421, respectively; the V$_H$ region comprises a CDR-H1, CDR-H2, and CDR-H3 comprising the sequence of SEQ ID NOS:2, 5, and 9, respectively, and the V$_L$ region comprises a CDR-L1, CDR-L2, and CDR-L3 comprising the sequence of SEQ ID NOS:387, 405, and 422, respectively; the V$_H$ region comprises a CDR-H1, CDR-H2, and CDR-H3 comprising the sequence of SEQ ID NOS:2, 5, and 9, respectively, and the V$_L$ region comprises a CDR-L1, CDR-L2, and CDR-L3 comprising the sequence of SEQ ID NOS:388, 406, and 423, respectively; the V$_H$ region comprises a CDR-H1, CDR-H2, and CDR-H3 comprising the sequence of SEQ ID NOS:2, 5, and 9, respectively, and the V$_L$ region comprises a CDR-L1, CDR-L2, and CDR-L3 comprising the sequence of SEQ ID NOS:388, 407, and 424, respectively; the V$_H$ region comprises a CDR-H1, CDR-H2, and CDR-H3 comprising the sequence of SEQ ID NOS:3, 6, and 376, respectively, and the V$_L$ region comprises a CDR-L1, CDR-L2, and CDR-L3 comprising the sequence of SEQ ID NOS:389, 408, and 425, respectively; the V$_H$ region comprises a CDR-H1, CDR-H2, and CDR-H3 comprising the sequence of SEQ ID NOS:2, 5, and 157, respectively, and the V$_L$ region comprises a CDR-L1, CDR-L2, and CDR-L3 comprising the sequence of SEQ ID NOS:390, 183, and 193, respectively; the V$_H$ region comprises a CDR-H1, CDR-H2, and CDR-H3 comprising the sequence of SEQ ID NOS:2, 374, and 9, respectively, and the V$_L$ region comprises a CDR-L1, CDR-L2, and CDR-L3 comprising the sequence of SEQ ID NOS:391, 409, and 426, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:392, 40, and 427, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:394, 39, and 429, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:395, 411, and 430, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:28, 39, and 49, respectively; the V$_H$ region comprises a CDR-H1, CDR-H2, and CDR-H3 comprising the sequence of SEQ ID NOS:2, 5, and 10, respectively, and the V$_L$ region comprises a CDR-L1, CDR-L2, and CDR-L3 comprising the sequence of SEQ ID NOS:396, 412, and 431, respectively; the V$_H$ region comprises a CDR-H1, CDR-H2, and CDR-H3 comprising the sequence of SEQ ID NOS:2, 5, and 10, respectively, and the V$_L$ region comprises a CDR-L1, CDR-L2, and CDR-L3 comprising the sequence of SEQ ID NOS:396, 412, and 58, respectively; the V$_H$ region comprises a CDR-H1, CDR-H2, and CDR-H3 comprising the sequence of SEQ ID NOS:2, 5, and 10, respectively, and the V$_L$ region comprises a CDR-L1, CDR-L2, and CDR-L3 comprising the sequence of SEQ ID NOS:397, 413, and 432, respectively; the V$_H$ region comprises a CDR-H1, CDR-H2, and CDR-H3 comprising the sequence of SEQ ID NOS:1, 4, and 7, respectively, and the V$_L$ region comprises a CDR-L1, CDR-L2, and CDR-L3 comprising the sequence of SEQ ID NOS:398, 414, and 433, respectively; the V$_H$ region comprises a CDR-H1, CDR-H2, and CDR-H3 comprising the sequence of SEQ ID NOS:288, 290, and 292, respectively, and the V$_L$ region comprises a CDR-L1, CDR-L2, and CDR-L3 comprising the sequence of SEQ ID NOS:302, 304, and 306, respectively; the V$_H$ region comprises a CDR-H1, CDR-H2, and CDR-H3 comprising the sequence of SEQ ID NOS:288, 290, and 292, respectively, and the V$_L$ region comprises a CDR-L1, CDR-L2, and CDR-L3 comprising the sequence of SEQ ID NOS:302, 304, and 306, respectively; the V$_H$ region comprises a CDR-H1, CDR-H2, and CDR-H3 comprising the sequence of SEQ ID NOS:289, 291, and 293, respectively, and the V$_L$ region comprises a CDR-L1, CDR-L2, and CDR-L3 comprising the sequence of SEQ ID NOS:303, 305, and 307, respectively; the V$_H$ region comprises a CDR-H1, CDR-H2, and CDR-H3 comprising the sequence of SEQ ID NOS:289, 291, and 293, respectively, and the V$_L$ region comprises a CDR-L1, CDR-L2, and CDR-L3 comprising the sequence of SEQ ID NOS:303, 305, and 307, respectively; or the V$_H$ region comprises a CDR-H1, CDR-H2, and CDR-H3 comprising the sequence of SEQ ID NOS:507, 513, and 517, respectively, and the V$_L$ region comprises a CDR-L1, CDR-L2, and CDR-L3 comprising the sequence of SEQ ID NOS:589, 590, and 591, respectively.

In some embodiments, the V$_H$ region comprises a CDR-H1, CDR-H2, and CDR-H3 comprising the sequence of SEQ ID NOS:596, 597, and 595, respectively, and the V$_L$ region comprises a CDR-L1, CDR-L2, and CDR-L3 comprising the sequence of SEQ ID NOS:601, 602, and 603, respectively. In some embodiments, the V$_H$ region comprises a CDR-H1, CDR-H2, and CDR-H3 comprising the sequence of SEQ ID NOS:598, 599, and 595, respectively, and the V$_L$ region comprises a CDR-L1, CDR-L2, and CDR-L3 comprising the sequence of SEQ ID NOS:601, 602, and 603, respectively. In some embodiments, the V$_H$ region comprises a CDR-H1, CDR-H2, and CDR-H3 comprising the sequence of SEQ ID NOS:611, 612, and 613, respectively, and the V$_L$ region comprises a CDR-L1, CDR-L2, and CDR-L3 comprising the sequence of SEQ ID NOS:614, 615, and 603, respectively.

In some embodiments, the V$_H$ region is or comprises the sequence of any of SEQ ID NOs: 617, 110-115, 247-256, 324, 325, 518-531, 533, 609, 772-774, or 814-832; and the V$_L$ region is or comprises the sequence of any of SEQ ID NOs: 618, 116-127, 257-267, 326, 327, 534-550, 552-557, 610, 775-777, or 833-849.

In some embodiments, the V$_H$ and V$_L$ regions of the antibody or antigen-binding fragment thereof comprise the amino acid sequences of SEQ ID NOs:110 and 116, respectively; the V$_H$ and V$_L$ regions of the antibody or antigen-binding fragment thereof comprise the amino acid sequences of SEQ ID NOs:111 and 117, respectively; the V$_H$ and V$_L$ regions of the antibody or antigen-binding fragment thereof comprise the amino acid sequences of SEQ ID NOs:110 and 118, respectively; the V$_H$ and V$_L$ regions of the antibody or antigen-binding fragment thereof comprise the amino acid sequences of SEQ ID NOs:110 and 119, respectively; the V$_H$ and V$_L$ regions of the antibody or antigen-binding fragment thereof comprise the amino acid sequences of SEQ ID NOs:110 and 120, respectively; the V$_H$ and V$_L$ regions of the antibody or antigen-binding fragment thereof comprise the amino acid sequences of SEQ ID NOs:110 and 121, respectively; the V$_H$ and V$_L$ regions of the antibody or antigen-binding fragment thereof comprise the amino acid sequences of SEQ ID NOs:110 and 122, respectively; the V$_H$ and V$_L$ regions of the antibody or antigen-binding fragment thereof comprise the amino acid sequences of SEQ ID NOs:110 and 123, respectively; the V$_H$ and V$_L$ regions of the antibody or antigen-binding fragment thereof comprise the amino acid sequences of SEQ ID NOs:112 and 124, respectively; the V$_H$ and V$_L$ regions of the antibody or antigen-binding fragment thereof comprise the amino acid sequences of SEQ ID NOs:113 and 125, respectively; the V$_H$ and V$_L$ regions of the antibody or antigen-binding fragment thereof comprise the amino acid sequences of SEQ ID NOs:114 and 126, respectively; the V$_H$ and V$_L$ regions of the antibody or antigen-binding fragment thereof comprise the amino acid sequences of SEQ ID NOs:115 and 127, respectively; the V$_H$ and V$_L$ regions of the antibody or antigen-binding fragment thereof comprise the amino acid sequences of SEQ ID NOs:247 and 257, respectively; the V$_H$ and V$_L$ regions of the antibody or antigen-binding fragment thereof comprise the amino acid sequences of SEQ ID NOs:248 and 258, respectively; the V$_H$ and V$_L$ regions of the antibody or antigen-binding fragment thereof comprise the amino acid sequences of SEQ ID NOs:249 and 259, respectively; the V$_H$ and V$_L$ regions of the antibody or antigen-binding fragment thereof comprise the amino acid sequences of SEQ ID NOs:250 and 260, respectively; the V$_H$ and V$_L$ regions of the antibody or antigen-binding fragment thereof comprise the amino acid sequences of SEQ ID NOs:251 and 261, respectively; the V$_H$ and V$_L$ regions of the antibody or antigen-binding fragment thereof comprise the amino acid sequences of SEQ ID NOs:252 and 262, respectively; the V$_H$ and V$_L$ regions of the antibody or antigen-binding fragment thereof comprise the amino acid sequences of SEQ ID NOs:253 and 263, respectively; the V$_H$ and V$_L$ regions of the antibody or antigen-binding fragment thereof comprise the amino acid sequences of SEQ ID NOs:254 and 264, respectively; the V$_H$ and V$_L$ regions of the antibody or antigen-binding fragment thereof comprise the amino acid sequences of SEQ ID NOs:255 and 265, respectively; the V$_H$ and V$_L$ regions of the antibody or antigen-binding fragment thereof comprise the amino acid sequences of SEQ ID NOs:256 and 266, respectively; the V$_H$ and V$_L$ regions of the antibody or antigen-binding fragment thereof comprise the amino acid sequences of SEQ ID NOs:256 and 267, respectively; the V$_H$ and V$_L$ regions of the antibody or antigen-binding fragment thereof comprise the amino acid sequences of SEQ ID NOs:518 and 534, respectively; the V$_H$ and V$_L$ regions of the antibody or antigen-binding fragment thereof comprise the amino acid sequences of SEQ ID NOs:519 and 535, respectively; the V$_H$ and V$_L$ regions of the antibody or antigen-binding fragment thereof comprise the amino acid sequences of SEQ ID NOs:115 and 536, respectively; the V$_H$ and V$_L$ regions of the antibody or antigen-binding fragment thereof comprise the amino acid sequences of SEQ ID NOs:520 and 264, respectively; the V$_H$ and V$_L$ regions of the antibody or antigen-binding fragment thereof comprise the amino acid sequences of SEQ ID NOs:521 and 537, respectively; the V$_H$ and V$_L$ regions of the antibody or antigen-binding fragment thereof comprise the amino acid sequences of SEQ ID NOs:522 and 538, respectively; the V$_H$ and V$_L$ regions of the antibody or antigen-binding fragment thereof comprise the amino acid sequences of SEQ ID NOs:523 and 539, respectively; the V$_H$ and V$_L$ regions of the antibody or antigen-binding fragment thereof comprise the amino acid sequences of SEQ ID NOs:519 and 540, respectively; the V$_H$ and V$_L$ regions of the antibody or antigen-binding fragment thereof comprise the amino acid sequences of SEQ ID NOs:524 and 541, respectively; the V$_H$ and V$_L$ regions of the antibody or antigen-binding fragment thereof comprise the amino acid sequences of SEQ ID NOs:525 and 261, respectively; the V$_H$ and V$_L$ regions of the antibody or antigen-binding fragment thereof comprise the amino acid sequences of SEQ ID NOs:526 and 542, respectively; the V$_H$ and V$_L$ regions of the antibody or antigen-binding fragment thereof comprise the amino acid sequences of SEQ ID NOs:527 and 543, respectively; the V$_H$ and V$_L$ regions of the antibody or antigen-binding fragment thereof comprise the amino acid sequences of SEQ ID NOs:528 and 544, respectively; the V$_H$ and V$_L$ regions of the antibody or antigen-binding fragment thereof comprise the amino acid sequences of SEQ ID NOs:529 and 545, respectively; the V$_H$ and V$_L$ regions of the antibody or antigen-binding fragment thereof comprise the amino acid sequences of SEQ ID NOs:528 and 546, respectively; the V$_H$ and V$_L$ regions of the antibody or antigen-binding fragment thereof comprise the amino acid sequences of SEQ ID NOs:522 and 547, respectively; the V$_H$ and V$_L$ regions of the antibody or antigen-binding fragment thereof comprise the amino acid sequences of SEQ ID NOs:256 and 548, respectively; the V$_H$ and V$_L$ regions of the antibody or antigen-binding fragment thereof comprise the amino acid sequences of SEQ ID NOs:530 and 549, respectively; the V$_H$ and V$_L$ regions of the antibody or antigen-binding fragment thereof comprise the amino acid sequences of SEQ ID NOs:531 and 550, respectively; the V$_H$ and V$_L$ regions of the antibody or antigen-binding fragment thereof comprise the amino acid sequences of SEQ ID NOs:519 and 552, respectively; the V$_H$ and V$_L$ regions of the antibody or antigen-binding fragment thereof comprise the amino acid sequences of SEQ ID NOs:110 and 553, respectively; the V$_H$ and V$_L$ regions of the antibody or antigen-binding fragment thereof comprise the amino acid sequences of SEQ ID NOs:110 and 118, respectively; the V$_H$ and V$_L$ regions of the antibody or antigen-binding fragment thereof comprise the amino acid sequences of SEQ ID NOs:533 and 554, respectively; the V$_H$ and V$_L$ regions of the antibody or antigen-binding fragment thereof comprise the amino acid sequences of SEQ ID NOs:115 and 555, respectively; the V$_H$ and V$_L$ regions of the antibody or antigen-binding fragment thereof comprise the amino acid sequences of SEQ ID NOs:524 and 556, respectively; the V$_H$ and V$_L$ regions of the antibody or antigen-binding fragment thereof comprise the amino acid sequences of SEQ ID NOs:519 and 557, respectively; the V$_H$ and V$_L$ regions of the antibody or antigen-binding fragment thereof comprise the amino acid sequences of SEQ ID NOs:324 and 326, respectively; the V$_H$ and V$_L$ regions of the antibody or antigen-binding fragment thereof comprise the amino acid sequences of SEQ ID NOs:325 and 327, respectively; the V$_H$ and V$_L$ regions of the antibody or antigen-binding fragment thereof comprise the amino acid sequences of SEQ ID NOs:609 and 610, respectively; the V$_H$ and V$_L$ regions of the antibody or antigen-binding fragment thereof comprise the amino acid sequences of SEQ ID NOs:617 and 618, respectively; the V$_H$ and V$_L$ regions of the antibody or antigen-binding fragment thereof comprise the amino acid sequences of SEQ ID NOs:772 and 775, respectively; the V$_H$ and V$_L$ regions of the antibody or antigen-binding fragment thereof comprise the amino acid sequences of SEQ ID NOs:773 and 776, respectively; the V$_H$ and V$_L$ regions of the antibody or antigen-binding fragment thereof comprise the amino acid sequences of SEQ ID NOs:774 and 777, respectively; the V$_H$ and V$_L$ regions of the antibody or antigen-binding fragment thereof comprise the amino acid sequences of SEQ ID NOs:815 and 833, respectively; the V$_H$ and V$_L$ regions of the antibody or antigen-binding fragment thereof comprise the amino acid sequences of SEQ ID NOs:816 and 834, respectively; the V$_H$ and V$_L$ regions of the antibody or antigen-binding fragment thereof comprise the amino acid sequences of SEQ ID NO:817 and 835, respectively; the V$_H$ and V$_L$ regions of the antibody or antigen-binding fragment thereof comprise the amino acid sequences of SEQ ID NO:818 and 836, respectively; the V$_H$ and V$_L$ regions of the antibody or antigen-binding fragment thereof comprise the amino acid sequences of SEQ ID NO:819 and 837, respectively; the V$_H$ and V$_L$ regions of the antibody or antigen-binding fragment thereof comprise the amino acid sequences of SEQ ID NO:820 and 838, respectively; the V$_H$ and V$_L$ regions of the antibody or antigen-binding fragment thereof comprise the amino acid sequences of SEQ ID NO:821 and 839, respectively; the V$_H$ and V$_L$ regions of the antibody or antigen-binding fragment thereof comprise the amino acid sequences of SEQ ID NO:822 and 840, respectively; the V$_H$ and V$_L$ regions of the antibody or antigen-binding fragment thereof comprise the amino acid sequences of SEQ ID NO:823 and 841, respectively; the V$_H$ and V$_L$ regions of the antibody or antigen-binding fragment thereof comprise the amino acid sequences of SEQ ID NO:824 and 842, respectively; the V$_H$ and V$_L$ regions of the antibody or antigen-binding fragment thereof comprise the amino acid sequences of SEQ ID NO:825 and 843, respectively; the V$_H$ and V$_L$ regions of the antibody or antigen-binding fragment thereof comprise the amino acid sequences of SEQ ID NO:826 and 844, respectively; the V$_H$ and V$_L$ regions of the antibody or antigen-binding fragment thereof comprise the amino acid sequences of SEQ ID NO:827 and 845, respectively; the V$_H$ and V$_L$ regions of the antibody or antigen-binding fragment thereof comprise the amino acid sequences of SEQ ID NO:828 and 846, respectively; the V$_H$ and V$_L$ regions of the antibody or antigen-binding fragment thereof comprise the amino acid sequences of SEQ ID NO:829 and 847, respectively; the V$_H$ and V$_L$ regions of the antibody or antigen-binding fragment thereof comprise the amino acid sequences of SEQ ID NO:830 and 847, respectively; the V$_H$ and V$_L$ regions of the antibody or antigen-binding fragment thereof comprise the amino acid sequences of SEQ ID NO:831 and 848, respectively; the V$_H$ and V$_L$ regions of the antibody or antigen-binding fragment thereof comprise the amino acid sequences of SEQ ID NO:832 and 849, respectively, or any antibody or antigen-binding fragment thereof that has at least 90% sequence identity to any of the above V$_H$ and V$_L$, such as at least 90%, 91%, 92%, 93%, 94%, 95%, 96%, 97%, 98%, or 99% sequence identity thereto.

For example, the V$_H$ and V$_L$ regions of the antibody or antigen-binding fragment thereof provided therein comprise the amino acid sequences selected from: SEQ ID NOs:110 and 116; SEQ ID NOs:111 and 117; SEQ ID NOs:110 and 118; SEQ ID NOs:110 and 119; SEQ ID NOs:110 and 120; SEQ ID NOs:110 and 121; SEQ ID NOs:110 and 122; SEQ ID NOs:110 and 123; SEQ ID NOs:112 and 124; SEQ ID NOs:113 and 125; SEQ ID NOs:114 and 126; SEQ ID NOs:115 and 127; SEQ ID NOs:247 and 257; SEQ ID NOs:248 and 258; SEQ ID NOs:249 and 259; SEQ ID NOs:250 and 260; SEQ ID NOs:251 and 261; SEQ ID NOs:252 and 262; SEQ ID NOs:253 and 263; SEQ ID NOs:254 and 264; SEQ ID NOs:255 and 265; SEQ ID NOs:256 and 266; SEQ ID NOs:256 and 267; SEQ ID NOs:518 and 534; SEQ ID NOs:519 and 535; SEQ ID NOs:115 and 536; SEQ ID NOs:520 and 264; SEQ ID NOs:521 and 537; SEQ ID NOs:522 and 538; SEQ ID NOs:523 and 539; SEQ ID NOs:519 and 540; SEQ ID NOs:524 and 541; SEQ ID NOs:525 and 261; SEQ ID NOs:526 and 542; SEQ ID NOs:527 and 543; SEQ ID NOs:528 and 544; SEQ ID NOs:529 and 545; SEQ ID NOs:528 and 546; SEQ ID NOs:522 and 547; SEQ ID NOs:256 and 548; SEQ ID NOs:530 and 549; SEQ ID NOs:531 and 550; SEQ ID NOs:519 and 552; SEQ ID NOs:110 and 553; SEQ ID NOs:110 and 118; SEQ ID NOs:533 and 554; SEQ ID NOs:115 and 555; SEQ ID NOs:524 and 556; SEQ ID NOs:519 and 557, SEQ ID NOs:324 and 326, SEQ ID NOs:325 and 327, SEQ ID NOs:609 and 610; SEQ ID NOs:617 and 618; SEQ ID NOs:772 and 775; SEQ ID NOs:773 and 776; SEQ ID NOs:774 and 777; SEQ ID NOs:815 and 833; SEQ ID NOs:816 and 834; SEQ ID NO:817 and 835; SEQ ID NO:818 and 836; SEQ ID NO:819 and 837; SEQ ID NO:820 and 838; SEQ ID NO:821 and 839; NO:822 and 840; SEQ ID NO:823 and 841; SEQ ID NO:824 and 842; SEQ ID NO:825 and 843; SEQ ID NO:826 and 844; SEQ ID NO:827 and 845; SEQ ID NO:828 and 846; SEQ ID NO:829 and 847; SEQ ID NO:830 and 847; SEQ ID NO:831 and 848; and SEQ ID NO:832 and 849, respectively, or any antibody or antigen-binding fragment thereof that has at least 90% sequence identity to any of the above V$_H$ and V$_L$, such as at least 90%, 91%, 92%, 93%, 94%, 95%, 96%, 97%, 98%, or 99% sequence identity thereto, or any antibody or antigen-binding fragment thereof that comprises a CDR-H1, CDR-H2 and CDR-H3 contained within the V$_H$ region and a CDR-L1, CDR-L2 and CDR-L3 contained within the V$_L$ region of any of the above V$_H$ and V$_L$.

In some embodiments, the V$_H$ and V$_L$ regions of the antibody or antigen-binding fragment thereof provided therein comprise the amino acid sequences selected from: SEQ ID NOs:617 and 618; SEQ ID NOs:256 and 267; SEQ ID NOs:519 and 535; SEQ ID NOs:115 and 536; or SEQ ID NOs:609 and 610; respectively, or any antibody or antigen-binding fragment thereof that has at least 90% sequence identity to any of the above V$_H$ and V$_L$, such as at least 90%, 91%, 92%, 93%, 94%, 95%, 96%, 97%, 98%, or 99% sequence identity thereto, or any antibody or antigen-binding fragment thereof that comprises a CDR-H1, CDR-H2 and CDR-H3 contained within the V$_H$ region and a CDR-L1, CDR-L2 and CDR-L3 contained within the V$_L$ region of any of the above V$_H$ and V$_L$.

In some embodiments, the V$_H$ and V$_L$ regions of the antibody or antigen-binding fragment thereof provided therein comprise the amino acid sequences selected from: SEQ ID NOs:617 and 618, or any antibody or antigen-binding fragment thereof that has at least 90% sequence identity to any of the above V$_H$ and V$_L$, such as at least 90%, 91%, 92%, 93%, 94%, 95%, 96%, 97%, 98%, or 99% sequence identity thereto, or any antibody or antigen-binding fragment thereof that comprises a CDR-H1, CDR-H2 and CDR-H3 contained within the V$_{H\ region\ and\ a\ CDR-L}$1, CDR-L2 and CDR-L3 contained within the V$_L$ region of any of the above V$_H$ and V$_L$.

In some embodiments, the antibody or antigen-binding fragment thereof is a single-chain antibody fragment, such as a single chain variable fragment (scFv) or a diabody or a single domain antibody (sdAb). In some embodiments, the antibody or antigen-binding fragment is a single domain antibody comprising only the V$_H$ region. In some embodiments, the antibody or antigen binding fragment is an scFv comprising a heavy chain variable (V$_H$) region and a light chain variable (V$_L$) region. In some embodiments, the single-chain antibody fragment (e.g. scFv) includes one or more linkers joining two antibody domains or regions, such as a heavy chain variable (V$_H$) region and a light chain variable (V$_L$) region. The linker typically is a peptide linker, e.g., a flexible and/or soluble peptide linker. Among the linkers are those rich in glycine and serine and/or in some cases threonine. In some embodiments, the linkers further include charged residues such as lysine and/or glutamate, which can improve solubility. In some embodiments, the linkers further include one or more proline.

Accordingly, the provided anti-BCMA antibodies include single-chain antibody fragments, such as scFvs and diabodies, particularly human single-chain antibody fragments, typically comprising linker(s) joining two antibody domains or regions, such V$_H$ and V$_L$ regions. The linker typically is a peptide linker, e.g., a flexible and/or soluble peptide linker, such as one rich in glycine and serine.

In some aspects, the linkers rich in glycine and serine (and/or threonine) include at least 80%, 85%, 90%, 91%, 92%, 93%, 94%, 95%, 96%, 97%, 98%, or 99% such amino acid(s). In some embodiments, they include at least at or about 50%, 55%, 60%, 70%, or 75%, glycine, serine, and/or threonine. In some embodiments, the linker is comprised substantially entirely of glycine, serine, and/or threonine. The linkers generally are between about 5 and about 50 amino acids in length, typically between at or about 10 and at or about 30, e.g., 10, 11, 12, 13, 14, 15, 16, 17, 18, 19, 20, 21, 22, 23, 24, 25, 26, 27, 28, 29, or 30, and in some examples between 10 and 25 amino acids in length. Exemplary linkers include linkers having various numbers of repeats of the sequence GGGGS (4GS; SEQ ID NO:359) or GGGS (3GS; SEQ ID NO:360), such as between 2, 3, 4, and 5 repeats of such a sequence. Exemplary linkers include those having or consisting of an sequence set forth in SEQ ID NO:361 (GGGGSGGGGSGGGGS). Exemplary linkers further include those having or consisting of the sequence set forth in SEQ ID NO:362 (GSTSGSGKPGSGEGSTKG). Exemplary linkers further include those having or consisting of the sequence set forth in SEQ ID NO:778 (SRGGGGSGGGGSGGGGSLEMA).

Accordingly, in some embodiments, the provided embodiments include single-chain antibody fragments, e.g., scFvs, comprising one or more of the aforementioned linkers, such as glycine/serine rich linkers, including linkers having repeats of GGGS (SEQ ID NO: 360) or GGGGS (SEQ ID NO: 359), such as the linker set forth in SEQ ID NO:361.

In some embodiments, the linker has an amino acid sequence containing the sequence set forth in SEQ ID NO:361. The fragment, e.g., scFv, may include a V$_H$ region or portion thereof, followed by the linker, followed by a V$_L$ region or portion thereof. The fragment, e.g., the scFv, may include the V$_L$ region or portion thereof, followed by the linker, followed by the V$_H$ region or portion thereof.

In some embodiments, the antigen-binding domain comprises the sequence selected from any one of SEQ ID NOs: 478, 128-139, 268-278, 329, 442, 558-576, 578-583, 585, or 769-771 or an amino acid sequence having at least 90%, 91%, 92%, 93%, 94%, 95%, 96%, 97%, 98%, or 99% sequence identity to the sequence selected from any one of SEQ ID NOs: 478, 128-139, 268-278, 329, 442, 558-576, 578-583, 585, or 769-771.

In some aspects, an scFv provided herein comprises the amino acid sequence selected from any one of SEQ ID NOs:128-139, 268-278, 328, 329, 442, 478, 558-576, 578-583, 585, 586, and 769-771, or has an amino acid sequence having at least at or about 90%, 91%, 92%, 93%, 94%, 95%, 96%, 97%, 98%, or 99% sequence identity to the amino acid sequence selected from any one of SEQ ID NOs: 128-139, 268-278, 328, 329, 442, 478, 558-576, 578-583, 585, 586, and 769-771.

For example, the scFv provided herein comprises the amino acid sequence selected from any of SEQ ID NOS: 128, 129, 130, 132, 133, 136, 137, 269, 273, 274, 275, 276, 277, 278, 328, 329, 442, 478, 558, 559, 560, 561, 562, 563, 564, 565, 566, 567, 568, 569, 570, 571, 572, 573, 574, 575, 576, 577, 578, 579, 580, 581, 582, 583 585, 586, 769, 770, 771, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, or 813 or has an amino acid sequence having at least at or about 90%, 91%, 92%, 93%, 94%, 95%, 96%, 97%, 98%, or 99% sequence identity to the amino acid sequence selected from any one of SEQ ID NOS: 128, 129, 130, 132, 133, 136, 137, 269, 273, 274, 275, 276, 277, 278, 328, 329, 442, 478, 558, 559, 560, 561, 562, 563, 564, 565, 566, 567, 568, 569, 570, 571, 572, 573, 574, 575, 576, 577, 578, 579, 580, 581, 582, 583 585, 586, 769, 770, 771, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, or 813.

Table 2 provides the SEQ ID NOS: of exemplary antigen-binding domains, such as antibodies or antigen-binding fragments, that can be comprised in the provided BCMA-binding receptors, such as anti-BCMA chimeric antigen receptors (CARs). In some embodiments, the BCMA-binding receptor contains a BCMA-binding antibody or fragment thereof, comprising a $V_H$ region that comprises the CDR-H1, CDR-H2, and CDR-H3 sequence and a $V_L$ region that comprises the CDR-L1, CDR-L2 and CDR-L3 sequence set forth in the SEQ ID NOS: listed in each row of Table 2 below (by Kabat numbering). In some embodiments, the BCMA-binding receptor contains a BCMA-binding antibody or fragment thereof, comprising a $V_H$ region sequence and a $V_L$ region sequence set forth in the SEQ ID NOS: listed in each row of Table 2 below, or an antibody comprising a $V_H$ and $V_L$ region amino acid sequence that has at least 90%, 91%, 92%, 93%, 94%, 95%, 96%, 97%, 98%, or 99% sequence identity to the $V_H$ region sequence and the $V_L$ region sequence set forth in the SEQ ID NOS: listed in each row of Table 2 below. In some embodiments, the BCMA-binding receptor contains a BCMA-binding antibody or fragment thereof, comprising a $V_H$ region sequence and a $V_L$ region sequence set forth in the SEQ ID NOS: listed in each row of Table 2 below. In some embodiments, the BCMA-binding receptor contains a BCMA-binding antibody or fragment thereof, comprising an scFv sequence set forth in the SEQ ID NOS: listed in each row of Table 2 below, or an antibody comprising an scFv amino acid sequence that has at least 90%, 91%, 92%, 93%, 94%, 95%, 96%, 97%, 98%, or 99% sequence identity to the scFv sequence set forth in the SEQ ID NOS: listed in each row of Table 2 below. In some embodiments, the BCMA-binding receptor contains a BCMA-binding antibody or fragment thereof, comprising an scFv sequence set forth in the SEQ ID NOS: listed in each row of Table 2 below.

TABLE 2

Sequence identifier (SEQ ID NO) for Exemplary Antigen-binding Domains

| Antigen-binding domain | CDR-H1 | CDR-H2 | CDR-H3 | CDR-L1 | CDR-L2 | CDR-L3 | $V_H$ | $V_L$ | scFv |
|---|---|---|---|---|---|---|---|---|---|
| BCMA-1 | 1 | 4 | 7 | 26 | 37 | 47 | 110 | 116 | 128 |
| BCMA-2 | 2 | 5 | 8 | 27 | 38 | 48 | 111 | 117 | 129 |
| BCMA-3 | 1 | 4 | 7 | 28 | 39 | 49 | 110 | 118 | 130 |
| BCMA-4 | 1 | 4 | 7 | 29 | 40 | 50 | 110 | 119 | 131 |
| BCMA-5 | 1 | 4 | 7 | 30 | 39 | 51 | 110 | 120 | 132 |
| BCMA-6 | 1 | 4 | 7 | 31 | 41 | 52 | 110 | 121 | 133 |
| BCMA-7 | 1 | 4 | 7 | 32 | 42 | 53 | 110 | 122 | 134 |
| BCMA-8 | 1 | 4 | 7 | 30 | 39 | 54 | 110 | 123 | 135 |
| BCMA-9 | 2 | 5 | 9 | 33 | 43 | 55 | 112 | 124 | 136 |
| BCMA-10 | 2 | 5 | 10 | 34 | 44 | 56 | 113 | 125 | 137 |
| BCMA-11 | 3 | 6 | 11 | 35 | 45 | 57 | 114 | 126 | 138 |
| BCMA-12 | 2 | 5 | 10 | 36 | 46 | 58 | 115 | 127 | 139 |
| BCMA-13 | 140 | 145 | 149 | 174 | 179 | 184 | 247 | 257 | 268 |
| BCMA-14 | 141 | 145 | 149 | 174 | 179 | 185 | 248 | 258 | 269 |
| BCMA-15 | 141 | 145 | 150 | 174 | 179 | 186 | 249 | 259 | 270 |
| BCMA-16 | 142 | 146 | 151 | 174 | 179 | 187 | 250 | 260 | 271 |
| BCMA-17 | 2 | 5 | 152 | 175 | 180 | 188 | 251 | 261 | 272 |
| BCMA-18 | 143 | 147 | 153 | 174 | 179 | 189 | 252 | 262 | 273 |
| BCMA-19 | 144 | 148 | 154 | 176 | 181 | 190 | 253 | 263 | 274 |
| BCMA-20 | 3 | 6 | 155 | 177 | 182 | 191 | 254 | 264 | 275 |
| BCMA-21 | 2 | 5 | 156 | 174 | 179 | 192 | 255 | 265 | 276 |
| BCMA-22 | 2 | 5 | 157 | 178 | 183 | 193 | 256 | 266 | 277 |
| BCMA-23 | 2 | 5 | 157 | 178 | 183 | 194 | 256 | 267 | 278 |
| BCMA-24 | 2 | 6 | 376 | 30 | 399 | 415 | 518 | 534 | 558 |
| BCMA-25 | 1 | 4 | 7 | 380 | 400 | 416 | 519 | 535 | 559 |
| BCMA-26 | 2 | 5 | 10 | 33 | 43 | 421 | 115 | 536 | 560 |
| BCMA-27 | 3 | 6 | 155 | 177 | 182 | 191 | 520 | 264 | 561 |
| BCMA-28 | 3 | 372 | 376 | 381 | 401 | 417 | 521 | 537 | 562 |
| BCMA-29 | 3 | 6 | 376 | 382 | 402 | 418 | 522 | 538 | 563 |
| BCMA-30 | 3 | 6 | 377 | 383 | 403 | 419 | 523 | 539 | 564 |
| BCMA-31 | 1 | 4 | 7 | 384 | 39 | 54 | 519 | 540 | 565 |
| BCMA-32 | 2 | 5 | 10 | 385 | 180 | 58 | 524 | 541 | 566 |
| BCMA-33 | 2 | 373 | 152 | 175 | 180 | 188 | 525 | 261 | 567 |
| BCMA-34 | 3 | 6 | 11 | 386 | 404 | 420 | 526 | 542 | 568 |
| BCMA-35 | 2 | 5 | 378 | 33 | 43 | 421 | 527 | 543 | 569 |
| BCMA-36 | 2 | 5 | 9 | 387 | 405 | 422 | 528 | 544 | 570 |
| BCMA-37 | 2 | 5 | 9 | 388 | 406 | 423 | 529 | 545 | 571 |
| BCMA-38 | 2 | 5 | 9 | 388 | 407 | 424 | 528 | 546 | 572 |
| BCMA-39 | 3 | 6 | 376 | 389 | 408 | 425 | 522 | 547 | 573 |
| BCMA-40 | 2 | 5 | 157 | 390 | 183 | 193 | 256 | 548 | 574 |
| BCMA-41 | 2 | 374 | 9 | 391 | 409 | 426 | 530 | 549 | 575 |
| BCMA-42 | 1 | 4 | 7 | 392 | 40 | 427 | 531 | 550 | 576 |
| BCMA-44 | 1 | 4 | 7 | 394 | 39 | 429 | 519 | 552 | 578 |
| BCMA-45 | 1 | 4 | 7 | 395 | 411 | 430 | 110 | 553 | 579 |
| BCMA-46 | 1 | 4 | 7 | 28 | 39 | 49 | 110 | 118 | 130 |
| BCMA-47 | 2 | 5 | 10 | 396 | 412 | 431 | 533 | 554 | 580 |
| BCMA-48 | 2 | 5 | 10 | 396 | 412 | 58 | 115 | 555 | 581 |
| BCMA-49 | 2 | 5 | 10 | 397 | 413 | 432 | 524 | 556 | 582 |
| BCMA-51 | 1 | 4 | 7 | 398 | 414 | 433 | 519 | 557 | 583 |
| BCMA-52 | 507 | 513 | 517 | 589 | 590 | 591 | 609 | 610 | 442 |
| BCMA-55 | 593 | 594 | 595 | 601 | 602 | 603 | 617 | 618 | 478 |

TABLE 2-continued

Sequence identifier (SEQ ID NO) for Exemplary Antigen-binding Domains

| Antigen-binding domain | CDR-H1 | CDR-H2 | CDR-H3 | CDR-L1 | CDR-L2 | CDR-L3 | $V_H$ | $V_L$ | scFv |
|---|---|---|---|---|---|---|---|---|---|
| BCMA-C1, VH-VL | 288 | 290 | 292 | 302 | 304 | 306 | 324 | 326 | 585 |
| BCMA-C1, VL-VH | 288 | 290 | 292 | 302 | 304 | 306 | 324 | 326 | 328 |
| BCMA-C2, VH-VL | 289 | 291 | 293 | 303 | 305 | 307 | 325 | 327 | 329 |
| BCMA-C2, VL, VH | 289 | 291 | 293 | 303 | 305 | 307 | 325 | 327 | 586 |
| BCMA-D1 | | | | | | | 772 | 775 | 769 |
| BCMA-D2 | | | | | | | 773 | 776 | 770 |
| BCMA-D3 | | | | | | | 774 | 777 | 771 |
| BCMA-D4 | | | | | | | 814 | | |
| BCMA-D5 | | | | | | | 815 | 833 | 781 |
| BCMA-D6 | | | | | | | 816 | 834 | 782 |
| BCMA-D7 | | | | | | | 816 | 834 | 783 |
| BCMA-D8 | | | | | | | 817 | 835 | 784 |
| BCMA-D9 | | | | | | | 817 | 835 | 785 |
| BCMA-D10 | | | | | | | 818 | 836 | 786 |
| BCMA-D11 | | | | | | | 818 | 836 | 787 |
| BCMA-D12 | | | | | | | 819 | 837 | 788 |
| BCMA-D13 | | | | | | | 819 | 837 | 789 |
| BCMA-D14 | | | | | | | 820 | 838 | 790 |
| BCMA-D15 | | | | | | | 820 | 838 | 791 |
| BCMA-D16 | | | | | | | 821 | 839 | 792 |
| BCMA-D17 | | | | | | | 821 | 839 | 793 |
| BCMA-D18 | | | | | | | 822 | 840 | 794 |
| BCMA-D19 | | | | | | | 822 | 840 | 795 |
| BCMA-D20 | | | | | | | 823 | 841 | 796 |
| BCMA-D21 | | | | | | | 823 | 841 | 797 |
| BCMA-D22 | | | | | | | 824 | 842 | 798 |
| BCMA-D23 | | | | | | | 824 | 842 | 799 |
| BCMA-D24 | | | | | | | 824 | 842 | 800 |
| BCMA-D25 | | | | | | | 825 | 843 | 801 |
| BCMA-D26 | | | | | | | 826 | 844 | 802 |
| BCMA-D27 | | | | | | | 827 | 845 | 803 |
| BCMA-D28 | | | | | | | 828 | 846 | 804 |
| BCMA-D29 | | | | | | | | | 805 |
| BCMA-D30 | | | | | | | 829 | 847 | 806 |
| BCMA-D31 | | | | | | | 830 | 847 | 807 |
| BCMA-D32 | | | | | | | 831 | 848 | 808 |
| BCMA-D33 | | | | | | | 832 | 849 | 809 |
| BCMA-D34 | | | | | | | | | 810 |
| BCMA-D35 | | | | | | | 832 | 849 | 811 |
| BCMA-D36 | | | | | | | 831 | 848 | 812 |
| BCMA-D37 | | | | | | | | | 813 |

Among the antibodies, e.g. antigen-binding fragments, in the provided CARs, are human antibodies. In some embodiments of a provided human anti-BCMA antibody, e.g., antigen-binding fragments, the human antibody contains a $V_H$ region that comprises a portion having at least 95%, 96%, 97%, 98%, 99%, or 100% sequence identity to an amino acid sequence encoded by a germline nucleotide human heavy chain V segment, a portion having at least 95%, 96%, 97%, 98%, 99%, or 100% sequence identity to an amino acid sequence encoded by a germline nucleotide human heavy chain D segment, and/or a portion having at least 95%, 96%, 97%, 98%, 99%, or 100% sequence identity to an amino acid sequence encoded by a germline nucleotide human heavy chain J segment; and/or contains a $V_L$ region that comprises a portion having at least 95%, 96%, 97%, 98%, 99%, or 100% sequence identity to an amino acid sequence encoded by a germline nucleotide human kappa or lambda chain V segment, and/or a portion having at least 95%, 96%, 97%, 98%, 99%, or 100% sequence identity to an amino acid sequence encoded by a germline nucleotide human kappa or lambda chain J segment. In some embodiments, the portion of the $V_H$ region corresponds to the CDR-H1, CDR-H2 and/or CDR-H3. In some embodiments, the portion of the $V_H$ region corresponds to the framework region 1 (FR1), FR2, FR2 and/or FR4. In some embodiments, the portion of the $V_L$ region corresponds to the CDR-L1, CDR-L2 and/or CDR-L3. In some embodiments, the portion of the $V_L$ region corresponds to the FR1, FR2, FR2 and/or FR4.

In some embodiments, the human antibody, e.g., antigen-binding fragment, contains a CDR-H1 having at least 95%, 96%, 97%, 98%, 99%, or 100% sequence identity to an amino acid sequence of the corresponding CDR-H1 region within a sequence encoded by a germline nucleotide human heavy chain V segment. For example, the human antibody in some embodiments contains a CDR-H1 having a sequence that is 100% identical or with no more than one, two or three amino acid differences as compared to the corresponding CDR-H1 region within a sequence encoded by a germline nucleotide human heavy chain V segment.

In some embodiments, the human antibody, e.g., antigen-binding fragment, contains a CDR-H2 having at least 95%, 96%, 97%, 98%, 99%, or 100% sequence identity to an amino acid sequence of the corresponding CDR-H2 region within a sequence encoded by a germline nucleotide human heavy chain V segment. For example, the human antibody in some embodiments contains a CDR-H2 having a sequence that is 100% identical or with no more than one, two or three amino acid difference as compared to the corresponding CDR-H2 region within a sequence encoded by a germline nucleotide human heavy chain V segment.

In some embodiments, the human antibody, e.g., antigen-binding fragment, contains a CDR-H3 having at least 95%, 96%, 97%, 98%, 99%, or 100% sequence identity to an amino acid sequence of the corresponding CDR-H3 region within a sequence encoded by a germline nucleotide human heavy chain V segment, D segment and J segment. For example, the human antibody in some embodiments contains a CDR-H3 having a sequence that is 100% identical or with no more than one, two or three amino acid differences as compared to the corresponding CDR-H3 region within a sequence encoded by a germline nucleotide human heavy chain V segment, D segment and J segment.

In some embodiments, the human antibody, e.g., antigen-binding fragment, contains a CDR-L1 having at least 95%, 96%, 97%, 98%, 99%, or 100% sequence identity to an amino acid sequence of the corresponding CDR-L1 region within a sequence encoded by a germline nucleotide human light chain V segment. For example, the human antibody in some embodiments contains a CDR-L1 having a sequence that is 100% identical or with no more than one, two or three amino acid differences as compared to the corresponding CDR-L1 region within a sequence encoded by a germline nucleotide human light chain V segment.

In some embodiments, the human antibody, e.g., antigen-binding fragment, contains a CDR-L2 having at least 95%, 96%, 97%, 98%, 99%, or 100% sequence identity to an amino acid sequence of the corresponding CDR-L2 region within a sequence encoded by a germline nucleotide human light chain V segment. For example, the human antibody in some embodiments contains a CDR-L2 having a sequence that is 100% identical or with no more than one, two or three amino acid difference as compared to the corresponding CDR-L2 region within a sequence encoded by a germline nucleotide human light chain V segment.

In some embodiments, the human antibody, e.g., antigen-binding fragment, contains a CDR-L3 having at least 95%, 96%, 97%, 98%, 99%, or 100% sequence identity to an amino acid sequence of the corresponding CDR-L3 region within a sequence encoded by a germline nucleotide human light chain V segment and J segment. For example, the human antibody in some embodiments contains a CDR-L3 having a sequence that is 100% identical or with no more than one, two or three amino acid differences as compared to the corresponding CDR-L3 region within a sequence encoded by a germline nucleotide human light chain V segment and J segment.

In some embodiments, the human antibody, e.g., antigen-binding fragment, contains a framework region that contains human germline gene segment sequences. For example, in some embodiments, the human antibody contains a $V_H$ region in which the framework region, e.g. FR1, FR2, FR3 and FR4, has at least 95%, 96%, 97%, 98%, 99%, or 100% sequence identity to a framework region encoded by a human germline antibody segment, such as a V segment and/or J segment. In some embodiments, the human antibody contains a $V_L$ region in which the framework region e.g. FR1, FR2, FR3 and FR4, has at least 95%, 96%, 97%, 98%, 99%, or 100% sequence identity to a framework region encoded by a human germline antibody segment, such as a V segment and/or J segment. For example, in some such embodiments, the framework region sequence contained within the $V_H$ region and/or $V_L$ region differs by no more than 10 amino acids, such as no more than 9, 8, 7, 6, 5, 4, 3, 2 or 1 amino acid, compared to the framework region sequence encoded by a human germline antibody segment.

In some embodiments, the reference antibody can be a mouse anti-BCMA scFv described in International Patent App. Pub. No. WO 2010/104949.

The antibody, e.g., antigen-binding fragment, may contain at least a portion of an immunoglobulin constant region, such as one or more constant region domain. In some embodiments, the constant regions include a light chain constant region and/or a heavy chain constant region 1 ($C_H1$). In some embodiments, the antibody includes a $C_H2$ and/or $C_H3$ domain, such as an Fc region. In some embodiments, the Fc region is an Fc region of a human IgG, such as an IgG1 or IgG4.

2. Spacer

In some embodiments, the recombinant receptor such as a CAR comprising an antibody (e.g., antigen-binding fragment) provided herein, further includes a spacer or spacer region. The spacer typically is a polypeptide spacer and in general is located within the CAR between the antigen binding domain and the transmembrane domain of the CAR. In some aspects, the spacer may be or include at least a portion of an immunoglobulin constant region or variant or modified version thereof, such as a hinge region of an immunoglobulin, such as an IgG hinge region, e.g., an IgG4 or IgG4-derived hinge region, and/or a $C_H1$/CL and/or Fc region. In some embodiments, the constant region or one or more of the portion(s) thereof is of a human IgG, such as of a human IgG4 or IgG1 or IgG2. In general, the spacer, such as the portion of the constant region, serves as a spacer region between the antigen-recognition component (e.g., scFv) and transmembrane domain. In some embodiments, the length and/or composition of the spacer is designed to optimize or promote certain features of the interaction between the CAR and its target; in some aspects, it is designed to optimize the biophysical synapse distance between the CAR-expressing cell and the cell expressing the target of the CAR during or upon or following binding of the CAR to its target on the target-expressing cell; in some aspects, the target expressing cell is a BCMA-expressing tumor cell. In some embodiments, The CAR is expressed by a T-cell, and the length of the spacer is of a length that is compatible for T-cell activation or to optimize CAR T-cell performance. In some embodiments, the spacer is a spacer region, located between the ligand-binding domain and the transmembrane domain, of the recombinant receptor, e.g., CAR. In some embodiments, the spacer region is a region located between the ligand-binding domain and the transmembrane domain, of the recombinant receptor, e.g., CAR.

In some embodiments, the spacer can be of a length that provides for increased responsiveness of the cell following antigen binding, as compared to in the absence of the spacer and/or in the presence of a different spacer, such as one different only in length. In some embodiments, the spacer is at least 100 amino acids in length, such as at least 110, 125, 130, 135, 140, 145, 150, 160, 170, 180, 190, 200, 210, 220, 230, 240, or 250 amino acids in length. In some examples, the spacer is at or about 12 amino acids in length or is no more than 12 amino acids in length. Exemplary spacers include those having at least about 10 to 300 amino acids, about 10 to 200 amino acids, about 50 to 175 amino acids, about 50 to 150 amino acids, about 10 to 125 amino acids, about 50 to 100 amino acids, about 100 to 300 amino acids, about 100 to 250 amino acids, about 125 to 250 amino acids, or about 200 to 250 amino acids, and including any integer between the endpoints of any of the listed ranges. In some embodiments, a spacer or spacer region is at least about 12 amino acids, at least about 119 amino acids or less, at least about 125 amino acids, at least about 200 amino acids, or at least about 220 amino acids, or at least about 225 amino acids in length.

In some embodiments, the spacer has a length of 125 to 300 amino acids in length, 125 to 250 amino acids in length, 125 to 230 amino acids in length, 125 to 200 amino acids in length, 125 to 180 amino acids in length, 125 to 150 amino acids in length, 150 to 300 amino acids in length, 150 to 250 amino acids in length, 150 to 230 amino acids in length, 150 to 200 amino acids in length, 150 to 180 amino acids in length, 180 to 300 amino acids in length, 180 to 250 amino acids in length, 180 to 230 amino acids in length, 180 to 200 amino acids in length, 200 to 300 amino acids in length, 200 to 250 amino acids in length, 200 to 230 amino acids in length, 230 to 300 amino acids in length, 230 to 250 amino acids in length or 250 to 300 amino acids in length. In some embodiments, the spacer is at least or at least about or is or is about 130, 140, 150, 160, 170, 180, 190, 200, 210, 220, 221, 222, 223, 224, 225, 226, 227, 228 or 229 amino acids in length, or a length between any of the foregoing.

Exemplary spacers include those containing portion(s) of an immunoglobulin constant region such as those containing an Ig hinge, such as an IgG hinge domain. In some aspects, the spacer includes an IgG hinge alone, an IgG hinge linked to one or more of a $C_H2$ and $C_H3$ domain, or IgG hinge linked to the $C_H3$ domain. In some embodiments, the IgG hinge, $C_H2$ and/or $C_H3$ can be derived all or in part from IgG4 or IgG2. In some embodiments, the spacer can be a chimeric polypeptide containing one or more of a hinge, $C_H2$ and/or $C_H3$ sequence(s) derived from IgG4, IgG2, and/or IgG2 and IgG4. In some embodiments, the hinge region comprises all or a portion of an IgG4 hinge region and/or of an IgG2 hinge region, wherein the IgG4 hinge region is optionally a human IgG4 hinge region and the IgG2 hinge region is optionally a human IgG2 hinge region; the $C_H2$ region comprises all or a portion of an IgG4 $C_H2$ region and/or of an IgG2 $C_H2$ region, wherein the IgG4 $C_H2$ region is optionally a human IgG4 $C_H2$ region and the IgG2 $C_H2$ region is optionally a human IgG2 $C_H2$ region; and/or the $C_H3$ region comprises all or a portion of an IgG4 $C_H3$ region and/or of an IgG2 $C_H3$ region, wherein the IgG4 $C_H3$ region is optionally a human IgG4 $C_H3$ region and the IgG2 $C_H3$ region is optionally a human IgG2 $C_H3$ region. In some embodiments, the hinge, $C_H2$ and $C_H3$ comprises all or a portion of each of a hinge region, $C_H2$ and $C_H3$ from IgG4. In some embodiments, the hinge region is chimeric and comprises a hinge region from human IgG4 and human IgG2; the $C_H2$ region is chimeric and comprises a $C_H2$ region from human IgG4 and human IgG2; and/or the $C_H3$ region is chimeric and comprises a $C_H3$ region from human IgG4 and human IgG2. In some embodiments, the spacer comprises an IgG4/2 chimeric hinge or a modified IgG4 hinge comprising at least one amino acid replacement compared to human IgG4 hinge region; an human IgG2/4 chimeric $C_H2$ region; and a human IgG4 $C_H3$ region.

In some embodiments, the spacer can be derived all or in part from IgG4 and/or IgG2 and can contain mutations, such as one or more single amino acid mutations in one or more domains. In some examples, the amino acid modification is a substitution of a proline (P) for a serine (S) in the hinge region of an IgG4. In some embodiments, the amino acid modification is a substitution of a glutamine (Q) for an asparagine (N) to reduce glycosylation heterogeneity, such as an N177Q mutation at position 177, in the $C_H2$ region, of the full-length IgG4 Fc sequence set forth in SEQ ID NO: 750 or an N176Q. at position 176, in the $C_H2$ region, of the full-length IgG2 Fc sequence set forth in SEQ ID NO: 749. In some embodiments, the spacer is or comprises an IgG4/2 chimeric hinge or a modified IgG4 hinge; an IgG2/4 chimeric $C_H2$ region; and an IgG4 $C_H3$ region and optionally is about 228 amino acids in length; or a spacer set forth in SEQ ID NO: 649. In some embodiments, the spacer comprises the amino acid sequence (SEQ ID NO: 649)
ESKYGPPCPPCPAPPVAGPSVFLFPPKPKDTLMISRTPEVTCVVVDVSQ

EDPEVQFNWYVDGVEVHNAKTKPREEQFQSTYRVVSVLIVLHQDWLNGK

EYKCKVSNKGLPSSIEKTISKAKGQPREPQVYTLPPSQEEMTKNQVSLT

CLVKGFYPSDIAVEWESNGQPENNYKTTPPVLDSDGSFFLYSRLTVDKS

RWQEGNVFSCSVMHEALHNHYTQKSLSLSLGK encoded by a polynucleotide that has been optimized for codon expression and/or to eliminate splice sites such as cryptic splice sites. In some embodiments, the coding sequence for the spacer comprises the nucleic acid sequence set forth in SEQ ID NO: 622. In some embodiments, the coding sequence for the spacer comprises the nucleic acid sequence set forth in SEQ ID NO: 855 or 856.

Additional exemplary spacers include, but are not limited to, those described in Hudecek et al. (2013) *Clin. Cancer Res.*, 19:3153, Hudecek et al. (2015) *Cancer Immunol. Res.*, 3(2):125-135, or international patent application publication number WO2014031687. In some embodiments, the nucleotide sequence of the spacer is optimized to reduce RNA heterogeneity following expression. In some embodiments, the nucleotide sequence of the spacer is optimized to reduce cryptic splice sites or reduce the likelihood of a splice event at a splice site.

In some embodiments, the spacer has the amino acid sequence set forth in SEQ ID NO:363, and is encoded by the polynucleotide sequence set forth in SEQ ID NO:364. In some embodiments, the spacer has the amino acid sequence set forth in SEQ ID NO:365. In some embodiments, the spacer has the amino acid sequence set forth in SEQ ID NO:366. In some embodiments, the spacer has the amino acid sequence set forth in SEQ ID NO: 630, and is encoded by the polynucleotide sequence set forth in SEQ ID NO: 629. In some embodiments, the spacer has an amino acid sequence set forth in SEQ ID NO: 649, encoded by the polynucleotide sequence set forth in SEQ ID NO: 621, 622, 855 or 856 or a polynucleotide that exhibits at least 85%, 86%, 87%, 88%, 89%, 90%, 91%, 92%, 93%, 94%, 95%, 96%, 97%, 98%, 99% or more sequence identity to SEQ ID NO: 621, 622, 855 or 856. In some embodiments, the spacer has an amino acid sequence that exhibits at least 85%, 86%, 87%, 88%, 89%, 90%, 91%, 92%, 93%, 94%, 95%, 96%, 97%, 98%, 99% or more sequence identity to SEQ ID NO: 649, encoded by a polynucleotide that has been optionally optimized for codon usage and/or to reduce RNA heterogeneity.

In some embodiments, the spacer is or comprises an amino acid sequence encoded by the nucleotide sequence set forth in SEQ ID NO:622.

3. Transmembrane Domain and Intracellular Signaling Components

The antigen-recognition component generally is linked to one or more intracellular signaling regions containing signaling components, such as signaling components that mimic stimulation and/or activation through an antigen receptor complex, such as a TCR complex, in the case of a CAR, and/or signal via another cell surface receptor. Thus, in some embodiments, the BCMA-binding molecule (e.g., antibody or antigen binding fragment thereof) is linked to one or more transmembrane domains such as those described herein and intracellular signaling regions or domains comprising one or more intracellular components such as those described herein. In some embodiments, the transmembrane domain is fused to the extracellular domain. In one embodiment, a transmembrane domain that naturally is associated with one of the domains in the receptor, e.g., CAR, is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane domains include those derived from (i.e. comprise at least the transmembrane domain(s) of) the alpha, beta or zeta chain of the T-cell receptor, CD3 epsilon, CD4, CD5, CD8, CD9, CD16, CD22, CD28, CD33, CD37, CD45, CD64, CD80, CD86, CD134, CD137, and/or CD154. For example, the transmembrane domain can be a CD28 transmembrane domain that comprises the sequence of amino acids set forth in SEQ ID NO: 624, encoded by the nucleic acid sequence set forth in SEQ ID NO: 623 or SEQ ID NO:688. Alternatively the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain. In some embodiments, the linkage is by linkers, spacers, and/or transmembrane domain(s).

Among the intracellular signaling regions or domains are those that mimic or approximate a signal through a natural antigen receptor, a signal through such a receptor in combination with a costimulatory receptor, and/or a signal through a costimulatory receptor alone. In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the intracellular signaling domain of the CAR.

The receptor, e.g., the CAR, generally includes an intracellular signaling region comprising at least one intracellular signaling component or components. In some embodiments, the receptor includes an intracellular component or signaling domain of a TCR complex, such as a TCR CD3 chain that mediates T-cell activation and cytotoxicity, e.g., CD3 zeta chain. Thus, in some aspects, the BCMA-binding antibody is linked to one or more cell signaling modules. In some embodiments, cell signaling modules include CD3 transmembrane domain, CD3 intracellular signaling domains, and/or other CD transmembrane domains. In some embodiments, the receptor, e.g., CAR, further includes a portion of one or more additional molecules such as Fc receptor γ, CD8, CD4, CD25, or CD16. For example, in some aspects, the CAR includes a chimeric molecule between CD3-zeta (CD3-ζ) or Fc receptor γ and CD8, CD4, CD25 or CD16.

In some embodiments, upon or following ligation of the CAR, the cytoplasmic domain or intracellular signaling domain of the CAR stimulates and/or activates at least one of the normal effector functions or responses of the immune cell, e.g., T cell engineered to express the CAR. For example, in some contexts, the CAR induces a function of a T cell such as cytolytic activity or T-helper activity, such as secretion of cytokines or other factors. In some embodiments, a truncated portion of an intracellular signaling domain of an antigen receptor component or costimulatory molecule is used in place of an intact immunostimulatory chain, for example, if it transduces the effector function signal. In some embodiments, the intracellular signaling domain or domains include the cytoplasmic sequences of the T cell receptor (TCR), and in some aspects also those of co-receptors that in the natural context act in concert with such receptor to initiate signal transduction following antigen receptor engagement, and/or any derivative or variant of such molecules, and/or any synthetic sequence that has the same functional capability.

In the context of a natural TCR, full activation generally requires not only signaling through the TCR, but also a costimulatory signal. Thus, in some embodiments, to promote full activation, a component for generating secondary or co-stimulatory signal is also included in the CAR. In other embodiments, the CAR does not include a component for generating a costimulatory signal. In some aspects, an additional CAR is expressed in the same cell and provides the component for generating the secondary or costimulatory signal.

T cell activation is in some aspects described as being mediated by two classes of cytoplasmic signaling sequences: those that initiate antigen-dependent primary activation through the TCR (primary cytoplasmic signaling sequences), and those that act in an antigen-independent manner to provide a secondary or co-stimulatory signal (secondary cytoplasmic signaling sequences). In some aspects, the CAR includes one or both of such classes of cytoplasmic signaling sequences.

In some aspects, the CAR includes a primary cytoplasmic signaling sequence that regulates primary stimulation and/or activation of the TCR complex. Primary cytoplasmic signaling sequences that act in a stimulatory manner may contain signaling motifs which are known as immunoreceptor tyrosine-based activation motifs or ITAMs. Examples of ITAM containing primary cytoplasmic signaling sequences include those derived from TCR or CD3 zeta, FcR gamma, CD3 gamma, CD3 delta and CD3 epsilon. In some embodiments, the intracellular signaling region or domain in the CAR contain(s) a cytoplasmic signaling domain, portion thereof, or sequence derived from CD3 zeta. In some embodiments the CD3 zeta comprises the sequence of amino acids set forth in SEQ ID NO: 628, encoded by the nucleic acid sequence set forth in SEQ ID NO: 627 or SEQ ID NO: 652.

In some embodiments, the CAR includes a signaling domain (e.g., an intracellular or cytoplasmic signaling domain) and/or transmembrane portion of a costimulatory molecule, such as a T cell costimulatory molecule. Exemplary costimulatory molecules include CD28, 4-1BB, OX40, DAP10, and ICOS. For example, a costimulatory molecule can be derived from 4-1BB and can comprise the amino acid sequence set forth in SEQ ID NO: 626, encoded by the nucleotide sequence set forth in SEQ ID NO: 625 or SEQ ID NO: 681. In some aspects, the same CAR includes both the stimulatory or activating components (e.g., cytoplasmic signaling sequence) and costimulatory components.

In some embodiments, the stimulatory or activating components are included within one CAR, whereas the costimulatory component is provided by another CAR recognizing another antigen. In some embodiments, the CARs include activating or stimulatory CARs, and costimulatory CARs, both expressed on the same cell (see WO2014/055668). In some aspects, the BCMA-targeting CAR is the stimulatory or activating CAR; in other aspects, it is the costimulatory CAR. In some embodiments, the cells further include inhibitory CARs (iCARs, see Fedorov et al., Sci. Transl. Medicine, 5(215) (December, 2013), such as a CAR recognizing an antigen other than BCMA, whereby a stimulatory or an activating signal delivered through the BCMA-targeting CAR is diminished or inhibited by binding of the inhibitory CAR to its ligand, e.g., to reduce off-target effects.

In certain embodiments, the intracellular signaling region comprises a CD28 transmembrane and signaling domain linked to a CD3 (e.g., CD3-zeta) intracellular domain. In some embodiments, the intracellular signaling domain comprises a chimeric CD28 and CD137 (4-1BB, TNFRSF9) co-stimulatory domains, linked to a CD3 zeta intracellular domain.

In some embodiments, the CAR encompasses one or more, e.g., two or more, costimulatory domains and a stimulatory or activation domain, e.g., primary activation domain, in the cytoplasmic portion. Exemplary CARs include intracellular components of CD3-zeta, CD28, and 4-1BB.

In some embodiments, the provided chimeric antigen receptor comprises: (a) an extracellular antigen-binding domain that specifically recognizes B cell maturation antigen (BCMA), such as any antigen-binding domain described herein; (b) a spacer of at least 125 amino acids in length; (c) a transmembrane domain; and (d) an intracellular signaling region. In some embodiments, the antigen-binding domain of such receptor, comprising a $V_H$ region and a $V_L$ region comprising the amino acid sequence of SEQ ID NOs:617 and 618, respectively, or a sequence of amino acids having at least 90% identity to SEQ ID NOS:617 and 618, respectively. In some embodiments, the antigen-binding domain of such receptor, comprising a $V_H$ region that is or comprises a CDR-H1, CDR-H2 and CDR-H3 contained within the $V_H$ region amino acid sequence of SEQ ID NO: 617; and a $V_L$ region that is or comprises a CDR-L1, CDR-L2 and CDR-L3 contained within the $V_L$ region amino acid sequence of SEQ ID NO: 618. In some embodiments, the antigen-binding domain of such receptor, comprising a $V_H$ region comprising a CDR-H1, CDR-H2, and CDR-H3 comprising SEQ ID NOS:593, 594, and 595, respectively, and a $V_L$ region comprising a CDR-L1, CDR-L2, and CDR-L3 comprising SEQ ID NOS:601, 602, and 603, respectively. In some embodiments, the antigen-binding domain of such receptor, comprising a $V_H$ region comprising a CDR-H1, CDR-H2, and CDR-H3 comprising SEQ ID NOS:596, 597, and 595, respectively, and a $V_L$ region comprising a CDR-L1, CDR-L2, and CDR-L3 comprising SEQ ID NOS:601, 602, and 603, respectively. In some embodiments, the antigen-binding domain of such receptor, comprising a $V_H$ region comprising a CDR-H1, CDR-H2, and CDR-H3 comprising SEQ ID NOS: 598, 599, and 595, respectively, and a $V_L$ region comprising a CDR-L1, CDR-L2, and CDR-L3 comprising SEQ ID NOS:601, 602, and 603, respectively. In some embodiments, the antigen-binding domain of such receptor, comprising a $V_H$ region comprising a CDR-H1, CDR-H2, and CDR-H3 comprising SEQ ID NOS: 611, 612, and 613, respectively, and a $V_L$ region comprising a CDR-L1, CDR-L2, and CDR-L3 comprising SEQ ID NOS: 614, 615, and 603, respectively. In some embodiments, the antigen-binding domain of such receptor, comprising a $V_H$ region that is or comprises the amino acid sequence of SEQ ID NO: 617; and a $V_L$ region that is or comprises the amino acid sequence of SEQ ID NO: 618. In some embodiments, the antigen-binding domain of such receptor, comprising the amino acid sequence of SEQ ID NO: 478. In some embodiments, the intracellular signaling region includes an stimulating cytoplasmic signaling domain. In some embodiments, the stimulating cytoplasmic signaling domain is capable of inducing a primary activation signal in a T cell, is a T cell receptor (TCR) component and/or includes an immunoreceptor tyrosine-based activation motif (ITAM). In some embodiments, the stimulating cytoplasmic signaling domain is or includes a cytoplasmic signaling domain of a CD3-zeta (CD3ζ) chain or a functional variant or signaling portion thereof. In some embodiments, the stimulating cytoplasmic domain is human or is derived from a human protein. In some embodiments, the stimulating cytoplasmic domain is or includes the sequence set forth in SEQ ID NO:628 or a sequence of amino acids that has at least 90% sequence identity to SEQ ID NO:628. In some embodiments, the nucleic acid encoding the stimulating cytoplasmic domain is or includes the sequence set forth in SEQ ID NO:627 or is a codon-optimized sequence and/or degenerate sequence thereof. In other embodiments, the nucleic acid encoding the stimulating cytoplasmic signaling domain is or includes the sequence set forth in SEQ ID NO:652. In some embodiments, the intracellular signaling region further includes a costimulatory signaling region. In some embodiments, the costimulatory signaling region includes an intracellular signaling domain of a T cell costimulatory molecule or a signaling portion thereof. In some embodiments, the costimulatory signaling region includes an intracellular signaling domain of a CD28, a 4-1BB or an ICOS or a signaling portion thereof. In some embodiments, the costimulatory signaling region includes an intracellular signaling domain of 4-1BB. In some embodiments, the costimulatory signaling region is human or is derived from a human protein. In other embodiments, the costimulatory signaling region is or includes the sequence set forth in SEQ ID NO:626 or a sequence of amino acids that exhibits at least 90% sequence identity to the sequence set forth in SEQ ID NO: 626. In some embodiments, the nucleic acid encoding the costimulatory region is or includes the sequence set forth in SEQ ID NO:625 or is a codon-optimized sequence and/or degenerate sequence thereof. In some embodiments, the nucleic acid encoding the costimulatory signaling region includes the sequence set forth in SEQ ID NO:681. In some embodiments, the costimulatory signaling region is between the transmembrane domain and the intracellular signaling region. In some embodiments, the transmembrane domain is or includes a transmembrane domain derived from CD4, CD28, or CD8. In some embodiments, the transmembrane domain is or includes a transmembrane domain derived from a CD28. In some embodiments, the transmembrane domain is human or is derived from a human protein. In other embodiments, the transmembrane domain is or includes the sequence set forth in SEQ ID NO:624 or a sequence of amino acids that exhibits at least 90% sequence identity to SEQ ID NO:624.

Provided are chimeric antigen receptors, comprising: (1) an extracellular antigen-binding domain that specifically binds human B cell maturation antigen (BCMA), wherein the extracellular antigen-binding domain comprises: (i) a variable heavy chain ($V_H$) comprising an amino acid sequence having at least 90%, 91%, 92%, 93%, 94%, 95%, 96%, 97%, 98%, or 99% sequence identity to the $V_H$ region sequence of SEQ ID NO: 617; and (ii) a variable light chain ($V_L$) region comprising an amino acid sequence having at least 90%, 91%, 92%, 93%, 94%, 95%, 96%, 97%, 98%, or 99% sequence identity to the $V_L$ region sequence of any of SEQ ID NO: 618; (2) a spacer set forth in SEQ ID NO: 649 or wherein the nucleic acid encoding the spacer is or comprises the sequence set forth in SEQ ID NO:622; (3) a transmembrane domain, optionally a transmembrane domain from a human CD28; and (4) an intracellular signaling region comprising a cytoplasmic signaling domain of a CD3-zeta (CD3ζ) chain and an intracellular signaling domain of a T cell costimulatory molecule. Also provided are polynucleotides encoding such a chimeric antigen receptor.

In some embodiments, the $V_H$ region comprises a CDR-H1, CDR-H2 and CDR-H3 contained within the $V_H$ region sequence of SEQ ID NO: 617; and the $V_L$ region comprises a CDR-L1, CDR-L2 and CDR-L3 contained within the $V_L$ region sequence of SEQ ID NO: 618; or the $V_H$ region comprises a CDR-H1, CDR-H2, and CDR-H3 comprising the sequence of SEQ ID NOS:593, 594, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:596, 597, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:598, 599, and 595, respectively, and the $V_L$ region comprises a CDR-L1, CDR-L2, and CDR-L3 comprising the sequence of SEQ ID NOS:601, 602, and 603, respectively; or the $V_H$ region comprises a CDR-H1, CDR-H2, and CDR-H3 comprising the sequence of SEQ ID NOS:611, 612, and 613, respectively, and the $V_L$ region comprises a CDR-L1, CDR-L2, and CDR-L3 comprising the sequence of SEQ ID NOS:614, 615, and 603, respectively.

Provided are chimeric antigen receptors, comprising: (1) an extracellular antigen-binding domain that specifically binds human B cell maturation antigen (BCMA), wherein the extracellular antigen-binding domain comprises: a variable heavy ($V_H$) region comprising a CDR-H1, CDR-H2 and CDR-H3 contained within the $V_H$ region sequence of SEQ ID NO: 617; and a variable light ($V_L$) region comprising a CDR-L1, CDR-L2 and CDR-L3 contained within the $V_L$ region sequence of SEQ ID NO: 618; or the $V_H$ region comprises a CDR-H1, CDR-H2 and CDR-H3 contained within the $V_H$ region sequence of SEQ ID NO: 617; and the $V_L$ region comprises a CDR-L1, CDR-L2 and CDR-L3 contained within the $V_L$ region sequence of SEQ ID NO: 618; or the $V_H$ region comprises a CDR-H1, CDR-H2, and CDR-H3 comprising the sequence of SEQ ID NOS:593, 594, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:596, 597, and 595, respectively, and the $V_L$ region comprises a CDR-L1, CDR-L2, and CDR-L3 comprising the sequence of SEQ ID NOS:601, 602, and 603, respectively; the $V_H$ region comprises a CDR-H1, CDR-H2, and CDR-H3 comprising the sequence of SEQ ID NOS:598, 599, and 595, respectively, and the $V_L$ region comprises a CDR-L1, CDR-L2, and CDR-L3 comprising the sequence of SEQ ID NOS:601, 602, and 603, respectively; or the $V_H$ region comprises a CDR-H1, CDR-H2, and CDR-H3 comprising the sequence of SEQ ID NOS:611, 612, and 613, respectively, and the $V_L$ region comprises a CDR-L1, CDR-L2, and CDR-L3 comprising the sequence of SEQ ID NOS:614, 615, and 603, respectively; (2) a spacer set forth in SEQ ID NO: 649 or wherein the nucleic acid encoding the spacer is or comprises the sequence set forth in SEQ ID NO:622; (3) a transmembrane domain, optionally a transmembrane domain from a human CD28; and (4) an intracellular signaling region comprising a cytoplasmic signaling domain of a human CD3-zeta (CD3ζ) chain and an intracellular signaling domain of a T cell costimulatory molecule, optionally from a human 4-1BB or a human CD28. Also provided are polynucleotides encoding such a chimeric antigen receptor.

In some embodiments, the extracellular antigen-binding domain comprises the $V_H$ region sequence of SEQ ID NO:617 and the $V_L$ region sequence of SEQ ID NO:618. In some embodiments, the antigen-binding domain of such receptor, comprising the amino acid sequence of SEQ ID NO: 478. In some embodiments, other domains, regions, or components of the chimeric antigen receptor includes any domains, regions, or components described herein.

4. Surrogate Marker

In some embodiments, the CAR further includes a surrogate marker, such as a cell surface marker (e.g., a truncated cell surface marker), which may be used to confirm transduction or engineering of the cell to express the receptor. For example, in some aspects, extrinsic marker genes are utilized in connection with engineered cell therapies to permit detection or selection of cells and, in some cases, also to promote cell suicide by ADCC. Exemplary marker genes include truncated epidermal growth factor receptor (EGFRt), which can be co-expressed with a transgene of interest (e.g., a CAR or TCR) in transduced cells (see, e.g., U.S. Pat. No. 8,802,374). EGFRt contains an epitope recognized by the antibody cetuximab (Erbitux®). For this reason, Erbitux® can be used to identify or select cells that have been engineered with the EGFRt construct, including in cells also co-engineered with another recombinant receptor, such as a chimeric antigen receptor (CAR). Additionally, EGFRt is commonly used as a suicide mechanism in connection with cell therapies. In some aspects, when EGFRt is co-expressed in cells with a transgene of interest (e.g. CAR or TCR), it can be targeted by the cetuximab monoclonal antibody to reduce or deplete the transferred gene-modified cells via ADCC (see U.S. Pat. No. 8,802,374 and Liu et al., Nature Biotech. 2016 April; 34(4): 430-434). Importantly, the suicide killing approach using tEGFR requires availability of the antibody epitope. Another example of such a marker gene is prostate-specific membrane antigen (PSMA) or a modified form thereof. PSMA or modified forms thereof may comprise a sequence of amino acids bound by or recognized by a PSMA-targeting molecule, such as an antibody or an antigen-binding fragment thereof. PSMA-targeting molecules can be used to identify or select cells that have been engineered with a PSMA or modified construct, including in cells also co-engineered with another recombinant receptor, such as a chimeric antigen receptor (CAR) provided herein. In some aspects, the marker includes all or part (e.g., truncated form) of CD34, a nerve growth factor receptor (NGFR), epidermal growth factor receptor (e.g., EGFR), or PSMA.

Exemplary surrogate markers can include truncated forms of cell surface polypeptides, such as truncated forms that are non-functional and to not transduce or are not capable of transducing a signal or a signal ordinarily transduced by the full-length form of the cell surface polypeptide, and/or do not or are not capable of internalizing. Exemplary truncated cell surface polypeptides including truncated forms of growth factors or other receptors such as a truncated human epidermal growth factor receptor 2 (tHER2), a truncated epidermal growth factor receptor (tEGFR, exemplary tEGFR sequence set forth in SEQ ID NO:11 or 76) or a prostate-specific membrane antigen (PSMA) or modified form thereof tEGFR may contain an epitope recognized by the antibody cetuximab (Erbitux®) or other therapeutic anti-EGFR antibody or binding molecule, which can be used to identify or select cells that have been engineered with the tEGFR construct and an encoded exogenous protein, and/or to eliminate or separate cells expressing the encoded exogenous protein. See U.S. Pat. No. 8,802,374 and Liu et al., Nature Biotech. 2016 April; 34(4): 430-434). In some aspects, the marker, e.g. surrogate marker, includes all or part (e.g., truncated form) of CD34, a NGFR, a CD19 or a truncated CD19, e.g., a truncated non-human CD19, or epidermal growth factor receptor (e.g., tEGFR). In some embodiments, the marker is or comprises a fluorescent protein, such as green fluorescent protein (GFP), enhanced green fluorescent protein (EGFP), such as super-fold GFP (sfGFP), red fluorescent protein (RFP), such as tdTomato, mCherry, mStrawberry, AsRed2, DsRed or DsRed2, cyan fluorescent protein (CFP), blue green fluorescent protein (BFP), enhanced blue fluorescent protein (EBFP), and yellow fluorescent protein (YFP), and variants thereof, including species variants, monomeric variants, and codon-optimized and/or enhanced variants of the fluorescent proteins. In some embodiments, the marker is or comprises an enzyme, such as a luciferase, the lacZ gene from E. coli, alkaline phosphatase, secreted embryonic alkaline phosphatase (SEAP), chloramphenicol acetyl transferase (CAT). Exemplary light-emitting reporter genes include luciferase (luc), β-galactosidase, chloramphenicol acetyltransferase (CAT), β-glucuronidase (GUS) or variants thereof.

In some embodiments, the marker is a selection marker. In some embodiments, the selection marker is or comprises a polypeptide that confers resistance to exogenous agents or drugs. In some embodiments, the selection marker is an antibiotic resistance gene. In some embodiments, the selection marker is an antibiotic resistance gene confers antibiotic resistance to a mammalian cell. In some embodiments, the selection marker is or comprises a Puromycin resistance gene, a Hygromycin resistance gene, a Blasticidin resistance gene, a Neomycin resistance gene, a Geneticin resistance gene or a Zeocin resistance gene or a modified form thereof.

In some embodiments, the nucleic acid encoding the marker is operably linked to a polynucleotide encoding for a linker sequence, such as a cleavable linker sequence, e.g., T2A. See WO2014031687. In some embodiments, introduction of a construct encoding the CAR and surrogate marker, separated by a T2A ribosome switch, can express two proteins from the same construct, such that the surrogate marker can be used as a marker to detect cells expressing such construct. In some embodiments, the surrogate marker, and optionally a linker sequence, can be any as disclosed in international publication no. WO2014031687. For example, the marker can be a truncated EGFR (tEGFR) or PSMA that is, optionally, linked to a linker sequence, such as a 2A cleavable linker sequence (e.g., a T2A, P2A, E2A or F2A cleavable linker, described elsewhere herein). An exemplary polypeptide for a truncated EGFR surrogate marker comprises the sequence of amino acids set forth in SEQ ID NO: 634 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 634. In some embodiments, the spacer is or comprises a glycine-serine rich sequence or other flexible linker such as known flexible linkers.

In some embodiments, the marker is a molecule, e.g., cell surface protein, not naturally found on T cells or not naturally found on the surface of T cells, or a portion thereof.

In some embodiments, the molecule is a non-self molecule, e.g., non-self protein, i.e., one that is not recognized as "self" by the immune system of the host into which the cells will be adoptively transferred.

In some embodiments, the marker serves no therapeutic function and/or produces no effect other than to be used as a marker for genetic engineering, e.g., for selecting cells successfully engineered. In other embodiments, the marker may be a therapeutic molecule or molecule otherwise exerting some desired effect, such as a ligand for a cell to be encountered in vivo, such as a costimulatory or immune checkpoint molecule to enhance and/or dampen responses of the cells following adoptive transfer and encounter with ligand.

In some cases, CARs are referred to as first, second, and/or third generation CARs. In some aspects, a first generation CAR is one that solely provides a CD3-chain induced signal upon or in response to antigen binding; in some aspects, a second-generation CARs is one that provides such a signal and costimulatory signal, such as one including an intracellular signaling domain from a costimulatory receptor such as CD28 or CD137; in some aspects, a third generation CAR in some aspects is one that includes multiple costimulatory domains of different costimulatory receptors.

In some embodiments, the chimeric antigen receptor includes an extracellular portion containing the antibody or fragment described herein. In some aspects, the chimeric antigen receptor includes an extracellular portion containing the antibody or fragment described herein and an intracellular signaling domain. In some embodiments, the antibody or fragment includes an scFv or a single-domain antibody comprising only the $V_H$ region and the intracellular signaling domain contains an ITAM. In some aspects, the intracellular signaling domain includes a signaling domain of a zeta chain of a CD3-zeta (CD3ζ) chain. In some embodiments, the chimeric antigen receptor includes a transmembrane domain linking the extracellular domain and the intracellular signaling domain. In some aspects, the transmembrane domain contains a transmembrane portion of CD28. The extracellular domain and transmembrane can be linked directly or indirectly. In some embodiments, the extracellular domain and transmembrane are linked by a spacer, such as any described herein. In some embodiments, the chimeric antigen receptor contains an intracellular domain of a co-stimulatory molecule (e.g., T cell costimulatory molecule), such as between the transmembrane domain and intracellular signaling domain. In some aspects, the T cell costimulatory molecule is CD28 or 4-1BB.

In some embodiments, the transmembrane domain of the receptor (e.g., CAR) is a transmembrane domain of human CD28 or variant thereof, e.g., a 27-amino acid transmembrane domain of a human CD28 (Accession No.: P10747.1). In some embodiments, the intracellular signaling domain comprises an intracellular costimulatory signaling domain of human CD28 or functional variant thereof, such as a 41 amino acid domain thereof and/or such a domain with an LL to GG substitution at positions 186-187 of a native CD28 protein. In some embodiments, the intracellular domain comprises an intracellular costimulatory signaling domain of 4-1BB or functional variant thereof, such as a 42-amino acid cytoplasmic domain of a human 4-1BB (Accession No. Q07011.1). In some embodiments, the intracellular signaling domain comprises a human CD3 zeta stimulatory signaling domain or functional variant thereof, such as an 112 AA cytoplasmic domain of isoform 3 of human CD3 (Accession No.: P20963.2) or a CD3 zeta signaling domain as described in U.S. Pat. No. 7,446,190.

For example, in some embodiments, the CAR includes a BCMA antibody or fragment, such as any of the human BCMA antibodies, including sdAbs and scFvs, described herein, a spacer such as any of the Ig-hinge containing spacers, a CD28 transmembrane domain, a CD28 intracellular signaling domain, and a CD3 zeta signaling domain. In some embodiments, the CAR includes the BCMA antibody or fragment, such as any of the human BCMA antibodies, including sdAbs and scFvs described herein, a spacer such as any of the Ig-hinge containing spacers, a CD28 transmembrane domain, a 4-1BB intracellular signaling domain, and a CD3 zeta signaling domain. In some embodiments, such CAR constructs further includes a T2A ribosomal skip element and/or a tEGFR sequence, e.g., downstream of the CAR.

In certain embodiments, multispecific binding molecules, e.g., multispecific chimeric receptors, such as multispecific CARs, can contain any of the multispecific antibodies, including, e.g. bispecific antibodies, multispecific single-chain antibodies, e.g., diabodies, triabodies, and tetrabodies, tandem di-scFvs, and tandem tri-scFvs, such as any described above in Section I.A.

B. Exemplary Features

In some aspects, the antibodies or antigen-binding fragments thereof, in the provided CARs, have one or more specified functional features, such as binding properties, including recognizing or binding to particular epitopes, such as to epitopes that are similar to or overlap with those specifically bound by other antibodies such as reference antibodies, or epitopes that are different from those specifically bound by other antibodies such as reference antibodies, the ability to compete for binding with other antibodies such as reference antibodies, and/or particular binding affinities. In other embodiments, the antibodies or antigen-binding fragments thereof, in the provided CARs, recognize, such as specifically recognize, or bind, e.g., specifically bind, to epitopes that are different from, or do not overlap with those specifically bound by other antibodies such as reference antibodies. For example, the epitopes specifically bound by the antibodies, in the provided CARs, are different from those specifically bound by other antibodies such as reference antibodies. In some embodiments, the antibodies and antigen binding fragments thereof do not directly compete for, or compete to a lower degree, with binding with other antibodies such as reference antibodies.

In some embodiments, the antibodies or antigen-binding fragments thereof specifically recognize or specifically bind to BCMA protein. In any of the embodiments, an antibody or antigen binding fragment, in the provided CARs, that specifically recognize BCMA, specifically binds BCMA. In some embodiments provided herein, BCMA protein refers to human BCMA, a mouse BCMA protein, or a non-human primate (e.g., cynomolgus monkey) BCMA protein. In some embodiments of any of the embodiments herein, BCMA protein refers to human BCMA protein. The observation that an antibody or other binding molecule binds to BCMA protein or specifically binds to BCMA protein does not necessarily mean that it binds to a BCMA protein of every species. For example, in some embodiments, features of binding to BCMA protein, such as the ability to specifically bind thereto and/or to compete for binding thereto with a reference antibody, and/or to bind with a particular affinity or compete to a particular degree, in some embodiments, refers to the ability with respect to a human BCMA protein and the antibody may not have this feature with respect to a BCMA protein of another species, such as mouse.

In some embodiments, the antibody or antigen-binding fragment binds to a mammalian BCMA protein, including to naturally occurring variants of BCMA, such as certain splice variants or allelic variants.

In some embodiments, the antibodies specifically bind to human BCMA protein, such as to an epitope or region of human BCMA protein, such as the human BCMA protein comprising the amino acid sequence of SEQ ID NO:367 (GenBank No. BAB60895.1), or SEQ ID NO:368 (NCBI No. NP_001183.2) or an allelic variant or splice variant thereof. In one embodiment, the human BCMA protein is encoded by a transcript variant or is an isoform that has the sequence of amino acids forth in SEQ ID NO:369. In some embodiments, the antibodies bind to cynomolgus monkey BCMA protein, such as the cynomolgus monkey BCMA protein set forth in SEQ ID NO:371 (GenBank No. EHH60172.1). In some embodiments, the antibodies bind to human BCMA but do not bind to or bind in a lower level or degree or affinity to cynomolgus monkey BCMA protein, such as the cynomolgus monkey BCMA protein set forth in SEQ ID NO:371 (GenBank No. EHH60172.1). In some embodiments, the antibodies do not bind to or bind in a lower level or degree or affinity to mouse BCMA protein, such as the mouse BCMA protein set forth in SEQ ID NO:370 (NCBI No. NP_035738.1). In some embodiments, the antibodies bind to mouse BCMA protein, such as the mouse BCMA protein set forth in SEQ ID NO:370 (NCBI No. NP_035738.1). In some embodiments, the antibodies bind to mouse BCMA protein, with lower affinity than its binding to a human BCMA protein and/or a cynomolgus monkey BCMA protein. In some embodiments, the antibodies bind to mouse BCMA protein and/or a cynomolgus monkey BCMA protein with lower affinity than its binding to a human BCMA protein. In some embodiments, the antibodies bind to mouse BCMA protein and/or a cynomolgus monkey BCMA protein with similar binding affinity compared to its binding to a human BCMA protein.

In some embodiments, the provided antigen-binding domain or CAR exhibits preferential binding to membrane-bound BCMA as compared to soluble BCMA. In some embodiments, the provided antigen-binding domain or CAR exhibits greater binding affinity for, membrane-bound BCMA compared to soluble BCMA.

In one embodiment, the extent of binding of an anti-BCMA antibody or antigen-binding domain or CAR to an unrelated, non-BCMA protein, such as a non-human BCMA protein or other non-BCMA protein, is less than at or about 10% of the binding of the antibody or antigen-binding domain or CAR to human BCMA protein or human membrane-bound BCMA as measured, e.g., by a radioimmunoassay (RIA). In some embodiments, among the antibodies or antigen-binding domains in the provided CARs, are antibodies or antigen-binding domains or CARs in which binding to mouse BCMA protein is less than or at or about 10% of the binding of the antibody to human BCMA protein. In some embodiments, among the antibodies or antigen-binding domains in the provided CARs, are antibodies in which binding to cynomolgus monkey BCMA protein is less than or at or about 10% of the binding of the antibody to human BCMA protein. In some embodiments, among the antibodies or antigen-binding domains in the provided CARs, are antibodies in which binding to cynomolgus monkey BCMA protein and/or a mouse BCMA protein is similar to or about the same as the binding of the antibody to human BCMA protein. In some embodiments, among the antibodies or antigen-binding domains in the provided CARs, are antibodies or antigen-binding domains or CARs in which binding to soluble BCMA protein is less than or at or about 10% of the binding of the antibody to membrane-bound BCMA protein.

In some embodiments, the antibody specifically binds to, and/or competes for binding thereto with a reference antibody, and/or binds with a particular affinity or competes to a particular degree, to a BCMA protein, e.g., human BCMA, a mouse BCMA protein, or a non-human primate (e.g., cynomolgus monkey) BCMA protein.

In some embodiments, the antibodies, in the provided CARs, are capable of binding BCMA protein, such as human BCMA protein, with at least a certain affinity, as measured by any of a number of known methods. In some embodiments, the affinity is represented by an equilibrium dissociation constant ($K_D$); in some embodiments, the affinity is represented by $EC_{50}$.

A variety of assays are known for assessing binding affinity and/or determining whether a binding molecule (e.g., an antibody or fragment thereof) specifically binds to a particular ligand (e.g., an antigen, such as a BCMA protein). It is within the level of a skilled artisan to determine the binding affinity of a binding molecule, e.g., an antibody, for an antigen, e.g., BCMA, such as human BCMA or cynomolgus BCMA or mouse BCMA, such as by using any of a number of binding assays that are well known in the art. For example, in some embodiments, a BIAcore® instrument can be used to determine the binding kinetics and constants of a complex between two proteins (e.g., an antibody or fragment thereof, and an antigen, such as a BCMA protein), using surface plasmon resonance (SPR) analysis (see, e.g., Scatchard et al., *Ann. N.Y. Acad. Sci.* 51:660, 1949; Wilson, *Science* 295:2103, 2002; Wolff et al., *Cancer Res.* 53:2560, 1993; and U.S. Pat. Nos. 5,283,173, 5,468,614, or the equivalent).

SPR measures changes in the concentration of molecules at a sensor surface as molecules bind to or dissociate from the surface. The change in the SPR signal is directly proportional to the change in mass concentration close to the surface, thereby allowing measurement of binding kinetics between two molecules. The dissociation constant for the complex can be determined by monitoring changes in the refractive index with respect to time as buffer is passed over the chip. Other suitable assays for measuring the binding of one protein to another include, for example, immunoassays such as enzyme linked immunosorbent assays (ELISA) and radioimmunoassays (RIA), or determination of binding by monitoring the change in the spectroscopic or optical properties of the proteins through fluorescence, UV absorption, circular dichroism, or nuclear magnetic resonance (NMR). Other exemplary assays include, but are not limited to, Western blot, ELISA, analytical ultracentrifugation, spectroscopy, flow cytometry, sequencing and other methods for detection of expressed polynucleotides or binding of proteins.

In some embodiments, the binding molecule, e.g., antibody or fragment thereof or antigen-binding domain of a CAR, binds, such as specifically binds, to an antigen, e.g., a BCMA protein or an epitope therein, with an affinity or $K_A$ (i.e., an equilibrium association constant of a particular binding interaction with units of 1/M; equal to the ratio of the on-rate [$k_{on}$ or $k_a$] to the off-rate [$k_{off}$ or $k_d$] for this association reaction, assuming bimolecular interaction) equal to or greater than $10^5$ M$^{-1}$. In some embodiments, the antibody or fragment thereof or antigen-binding domain of a CAR exhibits a binding affinity for the peptide epitope with a $K_D$ (i.e., an equilibrium dissociation constant of a particular binding interaction with units of M; equal to the ratio of the off-rate [$k_{off}$ or $k_d$] to the on-rate [$k_{on}$ or $k_a$] for this association reaction, assuming bimolecular interaction) of equal to or less than $10^{-5}$ M. For example, the equilibrium dissociation constant $K_D$ ranges from $10^{-5}$ M to $10^{-13}$M, such as $10^{-7}$ M to $10^{-11}$ M, $10^{-8}$M to $10^{-10}$ M, or $10^{-9}$ M to $10^{-10}$ M. The on-rate (association rate constant; $k_{on}$ or $k_a$; units of 1/Ms) and the off-rate (dissociation rate constant; $k_{off}$ or $k_d$; units of 1/s) can be determined using any of the assay methods known in the art, for example, surface plasmon resonance (SPR).

In some embodiments, the binding affinity ($EC_{50}$) and/or the dissociation constant of the antibody (e.g. antigen-binding fragment) or antigen-binding domain of a CAR to about BCMA protein, such as human BCMA protein, is from or from about 0.01 nM to about 500 nM, from or from about 0.01 nM to about 400 nM, from or from about 0.01 nM to about 100 nM, from or from about 0.01 nM to about 50 nM, from or from about 0.01 nM to about 10 nM, from or from about 0.01 nM to about 1 nM, from or from about 0.01 nM to about 0.1 nM, is from or from about 0.1 nM to about 500 nM, from or from about 0.1 nM to about 400 nM, from or from about 0.1 nM to about 100 nM, from or from about 0.1 nM to about 50 nM, from or from about 0.1 nM to about 10 nM, from or from about 0.1 nM to about 1 nM, from or from about 0.5 nM to about 200 nM, from or from about 1 nM to about 500 nM, from or from about 1 nM to about 100 nM, from or from about 1 nM to about 50 nM, from or from about 1 nM to about 10 nM, from or from about 2 nM to about 50 nM, from or from about 10 nM to about 500 nM, from or from about 10 nM to about 100 nM, from or from about 10 nM to about 50 nM, from or from about 50 nM to about 500 nM, from or from about 50 nM to about 100 nM or from or from about 100 nM to about 500 nM. In certain embodiments, the binding affinity ($EC_{50}$) and/or the equilibrium dissociation constant, $K_D$, of the antibody to a BCMA protein, such as human BCMA protein, is at or less than or about 400 nM, 300 nM, 200 nM, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM or less. In some embodiments, the antibodies bind to a BCMA protein, such as human BCMA protein, with a sub-nanomolar binding affinity, for example, with a binding affinity less than about 1 nM, such as less than about 0.9 nM, about 0.8 nM, about 0.7 nM, about 0.6 nM, about 0.5 nM, about 0.4 nM, about 0.3 nM, about 0.2 nM or about 0.1 nM or less.

In some embodiments, the binding affinity may be classified as high affinity or as low affinity. In some cases, the binding molecule (e.g. antibody or fragment thereof) or antigen-binding domain of a CAR that exhibits low to moderate affinity binding exhibits a $K_A$ of up to $10^7$M$^{-1}$, up to $10^6$M$^{-1}$, up to $10^5$M$^{-1}$. In some cases, a binding molecule (e.g. antibody or fragment thereof) that exhibits high affinity binding to a particular epitope interacts with such epitope with a $K_A$ of at least $10^7$M$^{-1}$, at least $10^8$ M$^{-1}$, at least $10^9$M$^{-1}$, at least $10^{10}$ M$^{-1}$, at least $10^{11}$ M$^{-1}$, at least $10^{12}$ M$^{-1}$, or at least $10^{13}$M$^{-1}$. In some embodiments, the binding affinity ($EC_{50}$) and/or the equilibrium dissociation constant, $K_D$, of the binding molecule, e.g., anti-BCMA antibody or fragment thereof or antigen-binding domain of a CAR, to a BCMA protein, is from or from about 0.01 nM to about 1

µM, 0.1 nM to 1 µM, 1 nM to 1 µM, 1 nM to 500 nM, 1 nM to 100 nM, 1 nM to 50 nM, 1 nM to 10 nM, 10 nM to 500 nM, 10 nM to 100 nM, 10 nM to 50 nM, 50 nM to 500 nM, 50 nM to 100 nM or 100 nM to 500 nM. In certain embodiments, the binding affinity ($EC_{50}$) and/or the dissociation constant of the equilibrium dissociation constant, $K_D$, of the binding molecule, e.g., anti-BCMA antibody or fragment thereof or antigen-binding domain of a CAR, to a BCMA protein, is at or about or less than at or about 1 µM, 500 nM, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM or less. The degree of affinity of a particular antibody can be compared with the affinity of a known antibody, such as a reference antibody.

In some embodiments, the binding affinity of a binding molecule, such as an anti-BCMA antibody or antigen-binding domain of a CAR, for different antigens, e.g., BCMA proteins from different species can be compared to determine the species cross-reactivity. For example, species cross-reactivity can be classified as high cross reactivity or low cross reactivity. In some embodiments, the equilibrium dissociation constant, $K_D$, for different antigens, e.g., BCMA proteins from different species such as human, cynomolgus monkey or mouse, can be compared to determine species cross-reactivity. In some embodiments, the species cross-reactivity of an anti-BCMA antibody or antigen-binding domain of a CAR can be high, e.g., the anti-BCMA antibody binds to human BCMA and a species variant BCMA to a similar degree, e.g., the ratio of $K_D$ for human BCMA and $K_D$ for the species variant BCMA is or is about 1. In some embodiments, the species cross-reactivity of an anti-BCMA antibody or antigen-binding domain of a CAR can be low, e.g., the anti-BCMA antibody has a high affinity for human BCMA but a low affinity for a species variant BCMA, or vice versa. For example, the ratio of $K_D$ for the species variant BCMA and $K_D$ for the human BCMA is more than 10, 15, 20, 25, 30, 40, 50, 60, 70, 80, 90, 100, 200, 500, 1000, 2000 or more, and the anti-BCMA antibody has low species cross-reactivity. The degree of species cross-reactivity can be compared with the species cross-reactivity of a known antibody, such as a reference antibody.

In some embodiments, the binding affinity of the anti-BCMA antibody or antigen-binding domain of a CAR, for different form or topological type of antigens, e.g., soluble BCMA protein compared to the binding affinity to a membrane-bound BCMA, to determine the preferential binding or relative affinity for a particular form or topological type. For example, in some aspects, the provided anti-BCMA antibodies or antigen-binding domains can exhibit preferential binding to membrane-bound BCMA as compared to soluble BCMA and/or exhibit greater binding affinity for, membrane-bound BCMA compared to soluble BCMA. In some embodiments, the equilibrium dissociation constant, $K_D$, for different form or topological type of BCMA proteins, can be compared to determine preferential binding or relative binding affinity. In some embodiments, the preferential binding or relative affinity to a membrane-bound BCMA compared to soluble BCMA can be high. For example, in some cases, the ratio of $K_D$ for soluble BCMA and the $K_D$ for membrane-bound BCMA is more than 10, 15, 20, 25, 30, 40, 50, 60, 70, 80, 90, 100, 200, 500, 1000, 2000 or more and the antibody or antigen-binding domain preferentially binds or has higher binding affinity for membrane-bound BCMA. In some cases, the ratio of $K_A$ for membrane-bound BCMA and the $K_A$ for soluble BCMA is more than 10, 15, 20, 25, 30, 40, 50, 60, 70, 80, 90, 100, 200, 500, 1000, 2000 or more and the antibody or antigen-binding domain preferentially binds or has higher binding affinity for membrane-bound BCMA. In some cases, the antibody or antigen-binding domain of CAR binds soluble BCMA and membrane-bound BCMA to a similar degree, e.g., the ratio of $K_D$ for soluble BCMA and $K_D$ for membrane-bound BCMA is or is about 1. In some cases, the antibody or antigen-binding domain of CAR binds soluble BCMA and membrane-bound BCMA to a similar degree, e.g., the ratio of $K_A$ for soluble BCMA and $K_A$ for membrane-bound BCMA is or is about 1. The degree of preferential binding or relative affinity for membrane-bound BCMA or soluble BCMA can be compared with that of a known antibody, such as a reference antibody.

In some embodiments, the antibodies or antigen binding fragments thereof, in the provided CARs, bind to a similar degree to a human BCMA protein and a non-human BCMA protein or other non-BCMA proteins. For example, in some embodiments, the antibodies or antigen binding fragments thereof or antigen-binding domain of a CAR bind to a human BCMA protein, such as the human BCMA protein comprising the amino acid sequence of SEQ ID NO:367 (GenBank No. BAB60895.1), or SEQ ID NO:368 (NCBI No. NP_001183.2) or an allelic variant or splice variant thereof, with an equilibrium dissociation constant ($K_D$), and to a non-human BCMA, such as a cynomolgus monkey BCMA, such as the cynomolgus monkey BCMA protein set forth in SEQ ID NO:371 (GenBank No. EHH60172.1), with a $K_D$ that is similar, or about the same, or less than 2-fold different, or less than 5-fold different.

In some embodiments, the antibodies or antigen binding fragments thereof, in the provided CARs, bind to a similar degree to a soluble BCMA protein and a membrane-bound BCMA protein, with an equilibrium dissociation constant ($K_D$) that is similar, or about the same, or less than 2-fold different, or less than 5-fold different.

For example, in some embodiments, the antibodies, in the provided CARs, or antigen binding fragments thereof bind to a human BCMA with a $K_D$ of about or less than at or about 1 µM, 500 nM, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM or less, and binds to a cynomolgus monkey BCMA with a $K_D$ of about or less than at or about 1 µM, 500 nM, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM or less. In some embodiments, the antibodies or antigen binding fragments thereof bind to a mouse BCMA protein with a $K_D$ of about or less than at or about 1 µM, 500 nM, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM or less. In some embodiments, the antibodies or antigen binding fragments thereof, in the provided CARs, bind to a human BCMA, a cynomolgus monkey BCMA and a mouse BCMA with high affinity. In some embodiments, the antibodies or antigen binding fragments thereof bind to a human BCMA and cynomolgus monkey BCMA with a high affinity, and to a mouse BCMA with low affinity. In some embodiments, the antibodies or antigen binding fragments thereof bind to a human BCMA and BCMA from other species, or other variants of the BCMA protein, with high affinity.

In some embodiments, the total binding capacity ($R_{max}$), as measured using particular surface plasmon resonance (SPR) conditions, is used to determine the ability or capacity of binding of the antibody or antigen binding fragment thereof, to the antigen, e.g., a BCMA protein, such as a human BCMA protein. For SPR analysis, the "ligand" is the immobilized target molecule on the surface of the sensor, for example, a BCMA protein, and the "analyte" is the tested molecule, e.g., antibody, for binding to the "ligand". For example, the "analyte" can be any of the antibodies, or antigen binding fragments thereof, that binds to a BCMA protein. For a particular ligand and analyte pair in SPR, the $R_{max}$ can be determined assuming a 1:1 binding stoichiometry model, for a particular condition. Binding capacity ($R_{max}$) was determined using the following formula: $R_{max}$ (RU)=(analyte molecular weight)/(ligand molecular weight)×immobilized ligand level (RU). For example, in a particular SPR conditions, the $R_{max}$ of binding between any of the antibody or antigen binding fragment thereof and a BCMA protein, such as a human BCMA or a cynomolgus BCMA, is at least or at least about 50 resonance units (RU), such as about 25 RU, 20 RU, 15 RU, 10 RU, 5 RU or 1 RU.

In some embodiments, the antibodies, such as the human antibodies, in the provided CAR, specifically bind to a particular epitope or region of BCMA protein, such as generally an extracellular epitope or region. BCMA protein is a type III membrane 184 amino acid protein that contains an extracellular domain, a transmembrane domain, and a cytoplasmic domain. With reference to a human BCMA amino acid sequence set forth in SEQ ID NO:367, the extracellular domain corresponds to amino acids 1-54, amino acids 55-77 correspond to the transmembrane domain, and amino acids 78-184 correspond to the cytoplasmic domain.

Among the provided CARs are CARs that exhibit antigen-dependent activity or signaling, i.e. signaling activity that is measurably absent or at background levels in the absence of antigen, e.g. BCMA. Thus, in some aspects, provided CARs do not exhibit, or exhibit no more than background or a tolerable or low level of, tonic signaling or antigen-independent activity or signaling in the absence of antigen, e.g. BCMA, being present. In some embodiments, the provided anti-BCMA CAR-expressing cells exhibit biological activity or function, including cytotoxic activity, cytokine production, and ability to proliferate.

In some embodiments, biological activity or functional activity of a chimeric receptor, such as cytotoxic activity, can be measured using any of a number of known methods. The activity can be assessed or determined either in vitro or in vivo. In some embodiments, activity can be assessed once the cells are administered to the subject (e.g., human). Parameters to assess include specific binding of an engineered or natural T cell or other immune cell to antigen, e.g., in vivo, e.g., by imaging, or ex vivo, e.g., by ELISA or flow cytometry. In certain embodiments, the ability of the engineered cells to destroy target cells can be measured using any suitable method known in the art, such as cytotoxicity assays described in, for example, Kochenderfer et al., J. Immunotherapy, 32(7): 689-702 (2009), and Herman et al. J. Immunological Methods, 285(1): 25-40 (2004). In certain embodiments, the biological activity of the cells also can be measured by assaying expression and/or secretion of certain cytokines, such as interleukin-2 (IL-2), interferon-gamma (IFNγ), interleukin-4 (IL-4), TNF-alpha (TNFα), interleukin-6 (IL-6), interleukin-10 (IL-10), interleukin-12 (IL-12), granulocyte-macrophage colony-stimulating factor (GM-CSF), CD107a, and/or TGF-beta (TGFβ). Assays to measure cytokines are well known in the art, and include but are not limited to, ELISA, intracellular cytokine staining, cytometric bead array, RT-PCR, ELISPOT, flow cytometry and bio-assays in which cells responsive to the relevant cytokine are tested for responsiveness (e.g. proliferation) in the presence of a test sample. In some aspects the biological activity is measured by assessing clinical outcome, such as reduction in tumor burden or load.

In some aspects, a reporter cell line can be employed to monitor antigen-independent activity and/or tonic signaling through anti-BCMA CAR-expressing cells. In some embodiments, a T cell line, such as a Jurkat cell line, contains a reporter molecule, such as a fluorescent protein or other detectable molecule, such as a red fluorescent protein, expressed under the control of the endogenous Nur77 transcriptional regulatory elements. In some embodiments, the Nur77 reporter expression is cell intrinsic and dependent upon signaling through a recombinant reporter containing a primary activation signal in a T cell, a signaling domain of a T cell receptor (TCR) component, and/or a signaling domain comprising an immunoreceptor tyrosine-based activation motif (ITAM), such as a CD3ζ chain. Nur77 expression is generally not affected by other signaling pathways such as cytokine signaling or toll-like receptor (TLR) signaling, which may act in a cell extrinsic manner and may not depend on signaling through the recombinant receptor. Thus, only cells that express the exogenous recombinant receptor, e.g. anti-BCMA CAR, containing the appropriate signaling regions is capable of expressing Nur77 upon stimulation (e.g., binding of the specific antigen). In some cases, Nur77 expression also can show a dose-dependent response to the amount of stimulation (e.g., antigen).

In some embodiments, the provided anti-BCMA CARs exhibit improved expression on the surface of cells, such as compared to an alternative CAR that has an identical amino acid sequence but that is encoded by non-splice site eliminated and/or a codon-optimized nucleotide sequence. In some embodiments, the expression of the recombinant receptor on the surface of the cell can be assessed. Approaches for determining expression of the recombinant receptor on the surface of the cell may include use of chimeric antigen receptor (CAR)-specific antibodies (e.g., Brentjens et al., Sci. Transl. Med. 2013 March; 5(177): 177ra38), Protein L (Zheng et al., J. Transl. Med. 2012 February; 10:29), epitope tags, and monoclonal antibodies that specifically bind to a CAR polypeptide (see international patent application Pub. No. WO2014190273). In some embodiments, the expression of the recombinant receptor on the surface of the cell, e.g., primary T cell, can be assessed, for example, by flow cytometry, using binding molecules that can bind to the recombinant receptor or a portion thereof that can be detected. In some embodiments, the binding molecules used for detecting expression of the recombinant receptor an anti-idiotypic antibody, e.g., an anti-idiotypic agonist antibody specific for a binding domain, e.g., scFv, or a portion thereof. In some embodiments, the binding molecule is or comprises an isolated or purified antigen, e.g., recombinantly expressed antigen.

C. Multispecific Antibodies

In certain embodiments, the BCMA-binding molecules, e.g., antibodies or polypeptides, such as chimeric receptors containing the same, are multispecific. Among the multispecific binding molecules are multispecific antibodies, including, e.g. bispecific antibodies. Multispecific binding partners, e.g., antibodies, have binding specificities for at least two different sites, which may be in the same or different antigens. In certain embodiments, one of the binding specificities is for BCMA and the other is for another antigen. In some embodiments, additional binding molecules bind to and/or recognize a third, or more antigens. In certain embodiments, bispecific antibodies may bind to two different epitopes of BCMA. Bispecific antibodies may also be used to localize cytotoxic agents to cells which express BCMA. Bispecific antibodies can be prepared as full length antibodies or antibody fragments. Among the multispecific antibodies are multispecific single-chain antibodies, e.g., diabodies, triabodies, and tetrabodies, tandem di-scFvs, and tandem tri-scFvs. Also provided are multispecific chimeric receptors, such as multispecific CARs, containing the antibodies (e.g., antigen-binding fragments). Also provided are multispecific cells containing the antibodies or polypeptides including the same, such as cells containing a cell surface protein including the anti-BCMA antibody and an additional cell surface protein, such as an additional chimeric receptor, which binds to a different antigen or a different epitope on BCMA.

Exemplary antigens include B cell specific antigens, other tumor-specific antigens, such as antigens expressed specifically on or associated with a leukemia (e.g., B cell leukemia), lymphoma (e.g., Hodgkin's lymphoma, non-Hodgkin's lymphoma, etc.), or a myeloma, e.g., a multiple myeloma (MM), a plasma cell malignancy (e.g., plasmacytoma). For example, antigens include those expressed specifically on or associated with B cell chronic lymphocytic leukemia (CLL), a diffuse large B-cell lymphoma (DLBCL), acute myeloid leukemia (AML), acute lymphocytic leukemia (ALL), Burkitt's lymphoma (e.g., endemic Burkitt's lymphoma or sporadic Burkitt's lymphoma), mantle cell lymphoma (MCL), non-small cell lung cancer (NSCLC), chronic myeloid (or myelogenous) leukemia (CML), hairy cell leukemia (HCL), small lymphocytic lymphoma (SLL), Marginal zone lymphoma, Hodgkin lymphoma (HL), non-Hodgkin lymphoma (NHL), Anaplastic large cell lymphoma (ALCL), refractory follicular lymphoma, Waldenstrom macroglobulinemia, follicular lymphoma, small non-cleaved cell lymphoma, mucosa-associated lymphatic tissue lymphoma (MALT), marginal zone lymphoma, nodal monocytoid B cell lymphoma, immunoblastic lymphoma, large cell lymphoma, diffuse mixed cell lymphoma, pulmonary B cell angiocentric lymphoma, small lymphocytic lymphoma, primary mediastinal B cell lymphoma, lymphoplasmacytic lymphoma (LPL), neuroblastoma, renal cell carcinoma, colon cancer, colorectal cancer, breast cancer, epithelial squamous cell cancer, melanoma, myeloma such as multiple myeloma (e.g., non-secretory multiple myeloma, smoldering multiple myeloma), stomach cancer, esophageal cancer, brain cancer, lung cancer (e.g., small-cell lung cancer), pancreatic cancer, cervical cancer, ovarian cancer, liver cancer (e.g., hepatic carcinoma, hepatoma, etc.), bladder cancer, prostate cancer, testicular cancer, thyroid cancer, uterine cancer, spleen cancer (e.g., splenic lymphoma), adrenal cancer and/or head and neck cancer, and antigens expressed on T cells.

In some embodiments, among the second or additional antigens for multi-targeting strategies includes those in which at least one of the antigens is a universal tumor antigen, or a family member thereof. In some embodiments, the second or additional antigen is an antigen expressed on a tumor. In some embodiments, the BCMA-binding molecules provided herein target an antigen on the same tumor type as the second or additional antigen. In some embodiments, the second or additional antigen may also be a universal tumor antigen or may be a tumor antigen specific to a tumor type.

Exemplary second or additional antigens include CD4, CD5, CD8, CD14, CD15, CD19, CD20, CD21, CD22, CD23, CD25, CD33, CD37, CD38, CD40, CD40L, CD46, CD52, CD54, CD74, CD80, CD126, CD138, B7, MUC-1, Ia, HM1.24, HLA-DR, tenascin, an angiogenesis factor, VEGF, PIGF, ED-B fibronectin, an oncogene, an oncogene product, CD66a-d, necrosis antigens, Ii, IL-2, T101, TAC, IL-6, ROR1, TRAIL-R1 (DR4), TRAIL-R2 (DR5), tEGFR, Her2, L1-CAM, mesothelin, CEA, hepatitis B surface antigen, anti-folate receptor, CD24, CD30, CD44, EGFR, EGP-2, EGP-4, EPHa2, ErbB2, ErbB3, ErbB4, erbB dimers, EGFR vIII, FBP, FCRL5, FCRH5, fetal acetylcholine receptor, GD2, GD3, G protein-coupled receptor class C group 5 member D (GPRCSD), HMW-MAA, IL-22R-alpha, IL-13R-alpha2, kdr, kappa light chain, Lewis Y, L1-cell adhesion molecule (L1-CAM), Melanoma-associated antigen (MAGE)-A1, MAGE-A3, MAGE-A6, Preferentially expressed antigen of melanoma (PRAME), survivin, EGP2, EGP40, TAG72, B7-H6, IL-13 receptor a2 (IL-13Ra2), CA9, CD171, G250/CAIX, HLA-AI MAGE A1, HLA-A2 NY-ESO-1, PSCA, folate receptor-a, CD44v6, CD44v7/8, avb6 integrin, 8H9, NCAM, VEGF receptors, 5T4, Foetal AchR, NKG2D ligands, dual antigen, an antigen associated with a universal tag, a cancer-testes antigen, MUC1, MUC16, NY-ESO-1, MART-1, gp100, oncofetal antigen, VEGF-R2, carcinoembryonic antigen (CEA), prostate specific antigen, PSMA, Her2/neu, estrogen receptor, progesterone receptor, ephrinB2, CD123, c-Met, GD-2, 0-acetylated GD2 (OGD2), CE7, Wilms Tumor 1 (WT-1), a cyclin, cyclin A2, CCL-1, hTERT, MDM2, CYP1B, WT1, livin, AFP, p53, cyclin (D1), CS-1, BAFF-R, TACI, CD56, TIM-3, CD123, L1-cell adhesion molecule, MAGE-A1, MAGE A3, a cyclin, such as cyclin A1 (CCNA1) and/or a pathogen-specific antigen, biotinylated molecules, molecules expressed by HIV, HCV, HBV and/or other pathogens, and/or in some aspects, neoepitopes or neoantigens thereof. In some embodiments, the antigen is associated with or is a universal tag.

In some aspects, the antigen, e.g., the second or additional antigen, such as the disease-specific antigen and/or related antigen, is expressed on multiple myeloma, such as G protein-coupled receptor class C group 5 member D (GPRCSD), CD38 (cyclic ADP ribose hydrolase), CD138 (syndecan-1, syndecan, SYN-1), CS-1 (CS1, CD2 subset 1, CRACC, SLAMF7, CD319, and 19A24), BAFF-R, TACI and/or FcRH5. Other exemplary multiple myeloma antigens include CD56, TIM-3, CD33, CD123, CD44, CD20, CD40, CD74, CD200, EGFR, β2-Microglobulin, HM1.24, IGF-1R, IL-6R, TRAIL-R1, and the activin receptor type IIA (ActRIIA). See Benson and Byrd, J. Clin. Oncol. (2012) 30(16): 2013-15; Tao and Anderson, Bone Marrow Research (2011): 924058; Chu et al., Leukemia (2013) 28(4):917-27; Garfall et al., Discov Med. (2014) 17(91):37-46. In some embodiments, the antigens include those present on lymphoid tumors, myeloma, AIDS-associated lymphoma, and/or post-transplant lymphoproliferations, such as CD38. Antibodies or antigen-binding fragments directed against such antigens are known and include, for example, those described in U.S. Pat. Nos. 8,153,765; 8,603,477, 8,008,450; U.S. Pub. No. US20120189622 or US20100260748; and/or International PCT Publication Nos. WO2006099875, WO2009080829 or WO2012092612 or WO2014210064. In some embodiments, such antibodies or antigen-binding fragments thereof (e.g. scFv) are contained in multispecific antibodies, multispecific chimeric receptors, such as multispecific CARs, and/or multispecific cells.

II. METHODS OF OPTIMIZING AND PRODUCING POLYNUCLEOTIDES, E.G., POLYNUCLEOTIDES ENCODING BCMA CARS, AND OPTIMIZED POLYNUCLEOTIDES

Provided herein are methods for optimizing polynucleotides for expression and/or therapeutic use, and polynucleotides optimized, e.g., according to the methods. In some embodiments, the provided methods or optimizations reduce heterogeneity and/or increase homogeneity of transcribed RNA, such as messenger RNA (mRNA), for example, when the polynucleotide is expressed in a cell, such as in a particular cell type, such as in a mammalian, e.g., human cell type such as a human T cell such as a primary human T cell or T cell line. In some embodiments, the methods for optimizing polynucleotides include methods to identify and remove or alter the sequence of one or more cryptic splice site, such as one or both of a donor splice site or an acceptor splice site. In some embodiments, the methods can additionally or further include codon optimization. In some embodiments, codon optimization can be performed prior to and/or after methods of reducing heterogeneity of transcribed RNA (e.g., mRNA), such as by removal or elimination of predicted splice sites. In some embodiments, codon optimization is integrated in any one or more steps of the method of reducing heterogeneity of transcribed RNAs. In some embodiments, methods of reducing heterogeneity, such as by removal or elimination of predicted splice sites, can be performed after codon optimization. In some embodiments, provided are methods in which a polynucleotide encoding a transgene, including a polynucleotide encoding any of the provided anti-BCMA CAR polypeptides, can be optimized for expression and/or for therapeutic use. In some embodiments, the polynucleotides are modified to optimize codon usage. In some embodiments, the polynucleotides are codon optimized for expression in a human cell such as a human T cell such as a primary human T cell. In some embodiments, the polynucleotides, such as those encoding any of the antibodies, receptors (such as antigen receptors such as chimeric antigen receptors) and/or BCMA-specific binding proteins provided herein, are or have been modified to reduce heterogeneity or contain one or more nucleic acid sequences observed herein (such as by the optimization methods) to result in improved features of the polypeptides, such as the CARs, as compared to those containing distinct, reference, sequences or that have not been optimized. Among such features include improvements in RNA heterogeneity, such as that resulting from the presence of one or more splice sites, such as one or more cryptic splice sites, and/or improved expression and/or surface expression of the encoded protein, such as increased levels, uniformity, or consistency of expression among cells or different therapeutic cell compositions engineered to express the polypeptides. In some embodiments, the polynucleotides can be codon optimized for expression in human cells.

Genomic nucleic acid sequences generally, in nature, in a mammalian cell, undergo processing co-transcriptionally or immediately following transcription, wherein a nascent precursor messenger ribonucleic acid (pre-mRNA), transcribed from a genomic deoxyribonucleic acid (DNA) sequence, is in some cases edited by way of splicing, to remove introns, followed by ligation of the exons in eukaryotic cells. Consensus sequences for splice sites are known, but in some aspects, specific nucleotide information defining a splice site may be complex and may not be readily apparent based on available methods. Cryptic splice sites are splice sites that are not predicted based on the standard consensus sequences and are variably activated. Hence, variable splicing of pre-mRNA at cryptic splice sites leads to heterogeneity in the transcribed mRNA products following expression in eukaryotic cells.

Polynucleotides generated for the expression of transgenes are typically constructed from nucleic acid sequences, such as complementary DNA (cDNA), or portions thereof, that do not contain introns. Thus, splicing of such sequences is not expected to occur. However, the presence of cryptic splice sites within the cDNA sequence can lead to unintended or undesired splicing reactions and heterogeneity in the transcribed mRNA. Such heterogeneity results in translation of unintended protein products, such as truncated protein products with variable amino acid sequences that exhibit modified expression and/or activity.

Also provided are methods and approaches for determining the heterogeneity of a transcribed nucleic acid such as one encoding or containing a transgene or encoding a recombinant protein. In some embodiments, the methods include determining the heterogeneity of a transcribed nucleic acid sequence that includes all or a portion of the 5' untranslated region (5' UTR), and/or all or a portion of the 3' untranslated region (3' UTR), of the transcribed nucleic acid. Also provided herein are methods of identifying the presence of splice sites, such as cryptic splice sites, based on the heterogeneity of the transcribed nucleic acid. Also provided are methods of identifying a transgene candidate for the removal of splice sites, such as cryptic splice sites, using the provided methods of determining the heterogeneity of the transcribed nucleic acid of the transgene. Also provided are methods of reducing the heterogeneity of an expressed transgene transcript.

Also provided herein are methods of identifying a transgene or recombinant protein or nucleic acid candidate for the removal or modification of one or more splice sites, such as cryptic splice sites, such as based on the determined heterogeneity of the transcribed nucleic acid, e.g., of the transgene.

Also provided are methods and approaches for reducing the heterogeneity of a transcribed nucleic acid (e.g., transcript) of a transgene (e.g., an expressed transgene transcript) or other nucleic acid. Such methods and approaches can include identifying a transgene candidate for the removal of splice sites (such as cryptic splice sites) according to the provided methods and identifying one or more potential splice donor and/or splice acceptor sites within the transgene. In embodiments of the provided methods the splice donor and/or splice acceptor sites can be in the translated and/or untranslated regions of the transcribed nucleic acid (e.g., transcript).

In some embodiments, eliminating splice sites, such as cryptic splice sites, can improve or optimize expression of a transgene product, such as a polypeptide translated from the transgene, such as an anti-BCMA CAR polypeptide. Splicing at cryptic splice sites of an encoded transgene, such as an encoded BMCA CAR molecule, can lead to reduced protein expression, e.g., expression on cell surfaces, and/or reduced function, e.g., reduced intracellular signaling. Provided herein are polynucleotides, encoding anti-BMCA CAR proteins that have been optimized to reduce or eliminate cryptic splice sites. Also provided herein are polynucleotides encoding anti-BCMA CAR proteins that have been optimized for codon expression and/or in which one or more sequence, such as one identified by the methods or observations herein regarding splice sites, is present, and/or in which an identified splice site, such as any of the identified splice sites herein, is not present. Among the provided polynucleotides are those exhibiting below a certain degree of RNA heterogeneity or splice forms when expressed under certain conditions and/or introduced into a specified cell type, such as a human T cell, such as a primary human T cell, and cells and compositions and articles of manufacture containing such polypeptides and/or exhibiting such properties.

In some embodiments, reducing RNA heterogeneity or removing potential splice site comprises modifying a polynucleotide. In some embodiments, the modification includes one or more nucleotide modifications, such as a replacement or substitution, compared to a reference polynucleotide such as an unmodified polynucleotide that encodes the same polypeptide. In some embodiments, the reference polynucleotide is one in which the transcribed RNA (e.g. mRNA), when expressed in a cell, exhibits greater than or greater than about 10%, 15%, 20%, 25%, 30%, 40%, 50% or more RNA heterogeneity. In some embodiments, the provided methods can result in polynucleotides in which RNA heterogeneity of transcribed RNA is reduced by greater than or greater than about 10%, 15%, 20%, 25%, 30%, 40%, 50% or more. In some embodiments, the provided methods produce polynucleotides in which RNA homogeneity of transcribed RNA is at least 70%, 75%, 80%, 85%, 90%, or 95% or greater.

A. Methods of Measuring and Reducing RNA Heterogeneity

Provided herein are methods, approaches, and strategies for measuring, evaluating and/or reducing RNA heterogeneity of a nucleic acid, such as of a transcribed RNA, e.g., when expressed in a particular cell type or context, as well as polynucleotides exhibiting reduction in such heterogeneity and/or risk thereof, as compared to a reference polynucleotide. In some embodiments, a reference polynucleotide can be assessed for RNA heterogeneity, such as by methods as described in this Section. In some embodiments, the provided approaches involve identifying RNA (e.g., mRNA) heterogeneity or likelihood thereof, such as in a particular cell or context, such as due to cryptic splice sites. In some aspects, such heterogeneity is identified by amplifying RNA transcripts using a first primer specific to the 5' untranslated region (5' UTR), corresponding to a portion of an element located upstream of the transgene in the transcribed RNA, such as a promoter, and a second primer specific to a 3' untranslated region (3' UTR), located downstream of the expressed transgene in the transcribed RNA sequence or specific to a sequence within the transgene. In some embodiments, the methods involve amplifying a transcribed nucleic acid using at least one 5' and 3' primer pair, wherein at least one pair comprises a 5' primer that is complementary to a nucleic acid sequence within the 5' untranslated region (5' UTR) of the transcribed nucleic acid and a 3' primer that is complementary to a nucleic acid sequence within the 3' untranslated region (3' UTR) of the transcribed nucleic acid to generate one or more amplified products. In some embodiments, the methods involve detecting the amplified products, wherein the presence of two or more amplified products from at least one 5' and 3' primer pair indicates heterogeneity in the amplified products. In some embodiments, the detected difference in transcripts are different lengths of the amplified transcript. In some embodiments, the detected difference in transcripts are differences in chromatographic profiles. Exemplary methods for identifying a polynucleotide with RNA heterogeneity are described below. In some embodiments, the methods comprise evaluating RNA heterogeneity for the need of being modified to reduce heterogeneity. In some embodiments, polynucleotides that exhibit RNA heterogeneity greater than or greater than about 10%, 15%, 20%, 25%, 30%, 40%, 50% or more are selected for nucleotide modification to remove one or more splice sites, such as one or more cryptic splice sites.

1. Measuring RNA Heterogeneity

RNA heterogeneity can be determined by any of a number of methods provided herein or described or known. In some embodiments, RNA heterogeneity of a transcribed nucleic acid is determined by amplifying the transcribed nucleic acid, such as by reverse transcriptase polymerase chain reaction (RT-PCR) followed by detecting one or more differences, such as differences in size, in the one or more amplified products. In some embodiments, the RNA heterogeneity is determined based on the number of differently sized amplified products, or the proportion of various differently sized amplified products. For example, in some embodiments, RNA heterogeneity is quantified by determining the number, amount or proportion of differently sized amplified product compared to the number or amount of total amplified products. In some cases, all or substantially all of a particular transcript is determined to be equal in size, and in this case, the RNA heterogeneity is low. In some cases, a variety of differently sized transcripts are present, or a large proportion of a particular transcript is of a different size compared to the predicted size of the amplified product without cryptic or undesired splicing events. In some embodiments, RNA heterogeneity can be calculated by dividing the total number or amount of all of amplified products that are of a different size compared to the predicted size of the amplified product by the total number or amount of all amplified products. In some embodiments, the predicted size of the transcript or amplified product is from an RNA that does not contain or is not predicted to contain a cryptic splice site. In some embodiments, the predicted size of the transcript or amplified product takes into account one or more splice sites that are desired or intentionally placed.

Figure 21A:
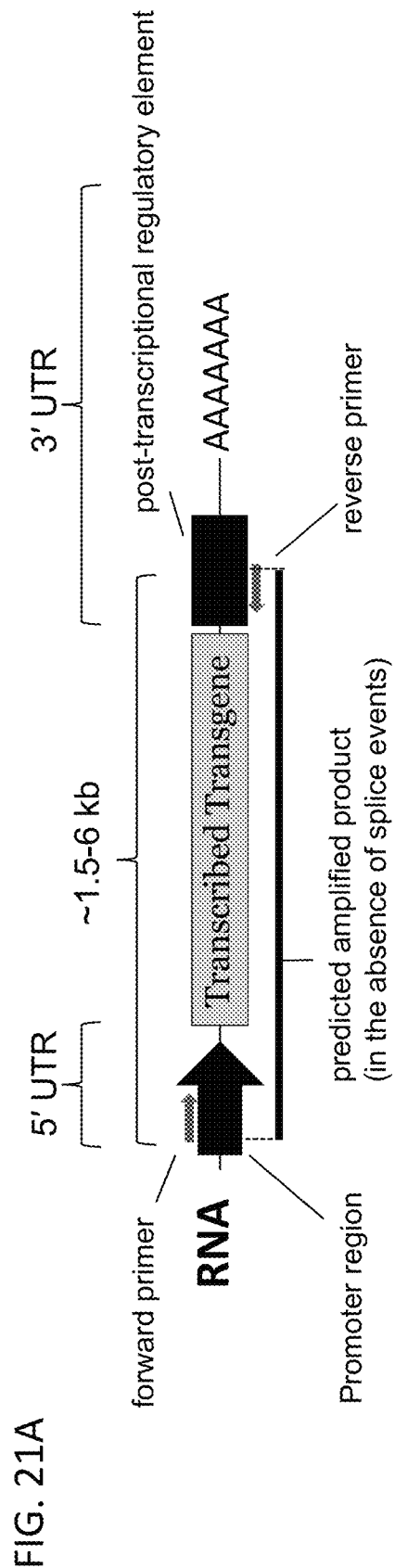
FIG. 21A depicts an exemplary amplification strategy for a transcript and predicted amplified product.
Figure 21B:
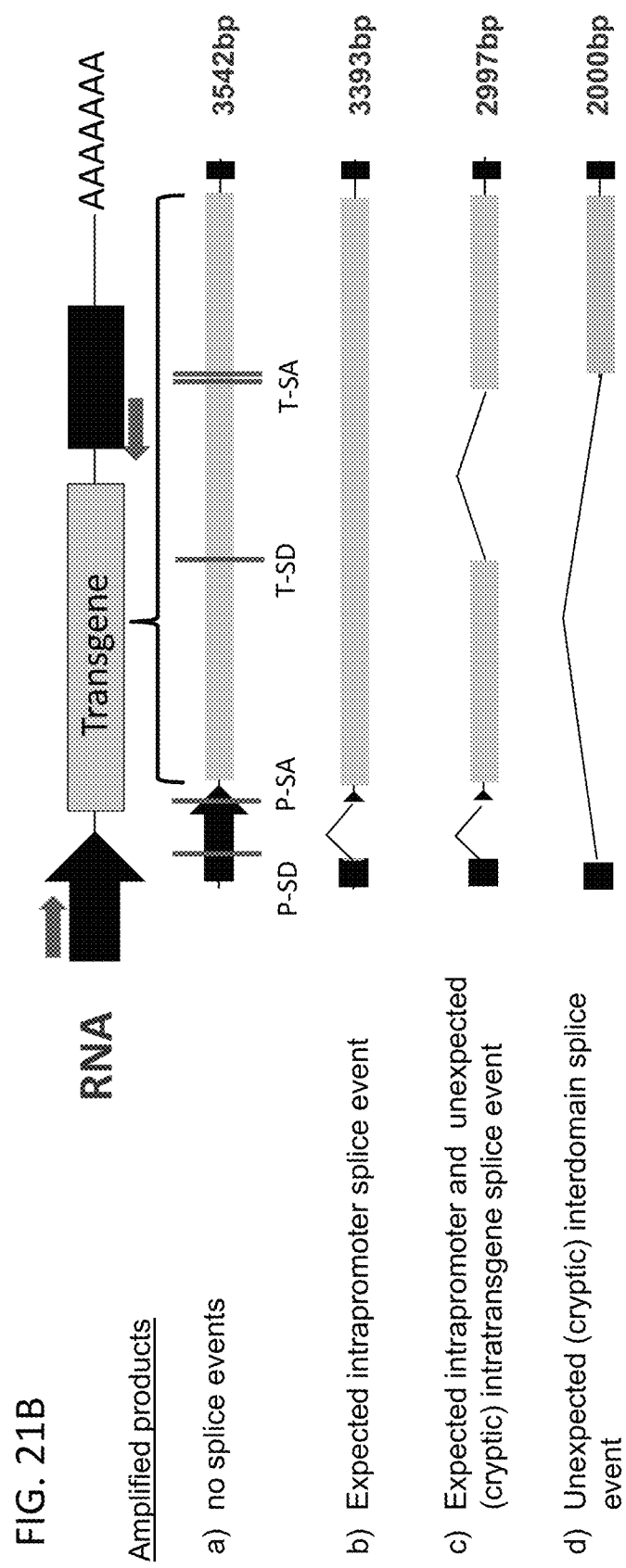
FIG. 21B depicts exemplary amplified products resulting from amplification of a transcript known and unknown (cryptic) splice sites.

In some embodiments, RNA, such as total RNA or cytoplasmic polyadenylated RNA, is harvested from cells, expressing the transgene to be optimized, and amplified by reverse transcriptase polymerase chain reaction (RT-PCR) using a primer specific to the 5' untranslated region (5' UTR), in some cases corresponding to a portion of the promoter sequence in the expression vector, located upstream of the transgene in the transcribed RNA, and a primer specific to the 3' untranslated region (3' UTR), located downstream of the expressed transgene in the transcribed RNA sequence or a primer specific to a sequence within the transgene. In particular embodiments, at least one primer complementary to a sequence in the 5' untranslated region (UTR) and at least one primer complementary to a sequence in the 3' untranslated region (UTR) are employed to amplify the transgene. An exemplary depiction of the amplification of a transcript and resulting product using a forward primer specific to the 5' UTR and a primer specific to a nucleotide sequence in the 3' UTR and a predicted amplified product, where no splice events have occurred, is provided in FIG. 21A. An exemplary depiction of exemplary multiple amplified products (i.e., heterogeneity) resulting from amplification of a transcript that has a 5' UTR, with a transcribed promoter sequence that contains a known splice donor site (P-SD) and a known splice acceptor site (P-SD), a transcribed transgene containing an unknown (cryptic) splice donor site (T-SD) and two unknown (cryptic) splice acceptor sites (T-SA) and a 3' UTR, using primers specific to regions of the 5' UTR and 3' UTR, is shown in FIG. 21B.

Exemplary primers specific for the 5' untranslated region (UTR) include primers directed to sequences within the promoter of the transgene. In some examples, a primer specific to an EF1a/HTLV promoter. An exemplary forward primer, specific to an EF1a-HTLV promoter is set forth in SEQ ID NO: 763.

Exemplary primers specific for the 3' untranslated region (UTR) include primers directed to 3' posttranscriptional regulatory elements located downstream of the transgene. Exemplary 3' posttranscriptional regulatory elements include the woodchuck hepatitis virus (WHP) posttranscriptional regulatory element (WPRE), set forth in SEQ ID NO: 636. An exemplary forward primer, specific to a WPRE is set forth in SEQ ID NO: 764.

Figure 21C:
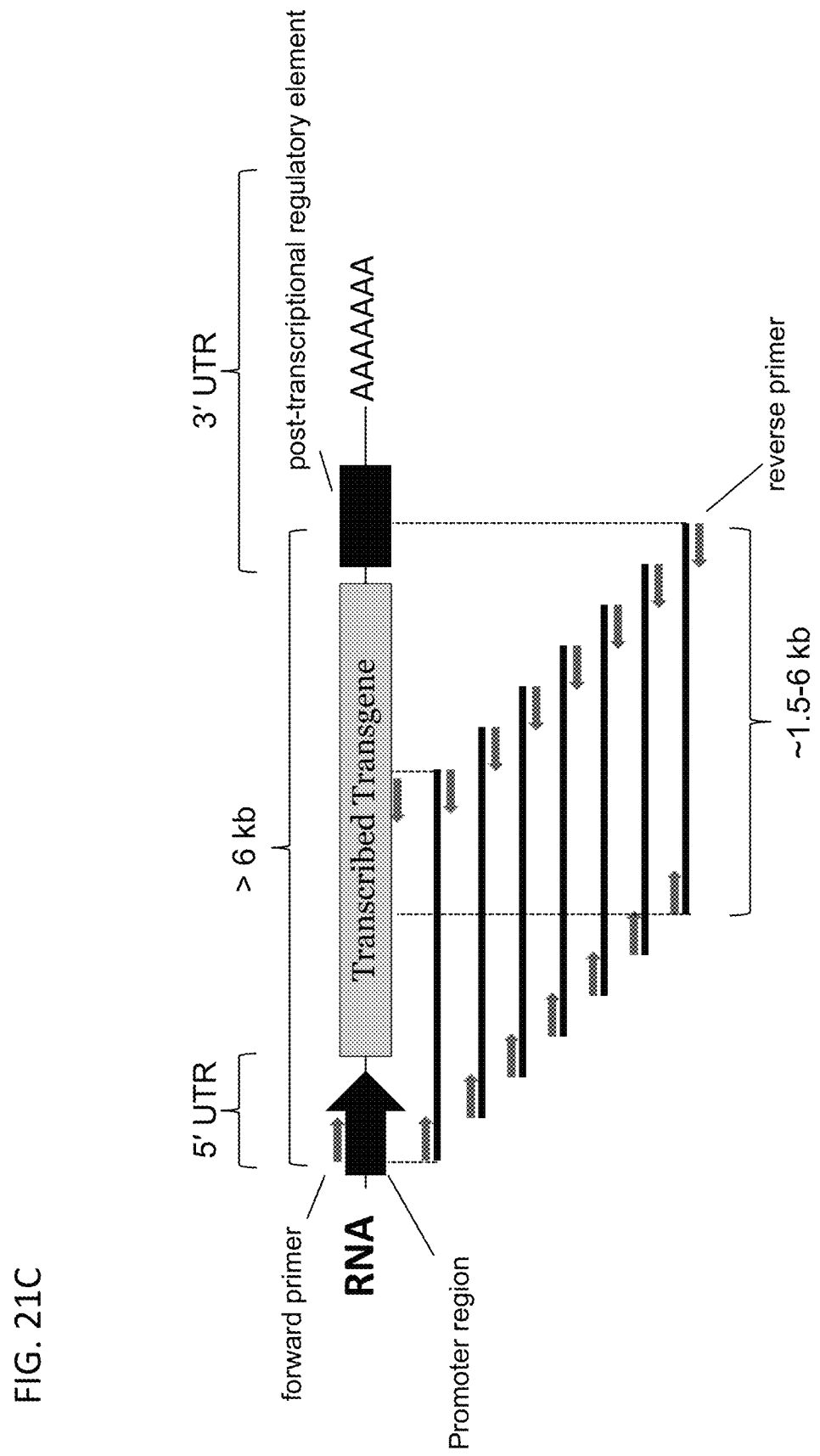
FIG. 21C depicts exemplary sliding window amplification of a transcript using nested primer pairs.

In some embodiments, multiple primer pairs can be used to amplify the transgene, such as for long transgenes. In some embodiments, sequential or nested pairs of forward and reverse primers, to crease a sliding window of amplified products, can be used to gain full and overlapping coverage of the sequence. Typically, the primers are designed to amplify a length of transgene that is approximately 1.5-6 kb, 2-6 kb, or 3-6 kb. An exemplary depiction of the amplification of a transcript using nested primer pairs is provided in FIG. 21C.

The amplified nucleic acid sequence is then analyzed for heterogeneity in terms of amplified transcript lengths. In some examples, heterogeneity is determined by the number and intensity of the bands for the expressed sequence. In some embodiments, RNA sequences having splice events upon expression generate multiple bands with different mobilities. In some embodiments, a major band is detected at the predicted mobility for a sequence not having any unpredicted splice events, and 1 or more additional bands of varying intensities and mobilities indicate the occurrence of one or more cryptic splice events within the transgene sequence.

The skilled artisan can resolve RNA, such as messenger RNA, and analyze the heterogeneity thereof by several methods. Non-limiting, exemplary methods include agarose gel electrophoresis, chip-based capillary electrophoresis, analytical centrifugation, field flow fractionation, and chromatography, such as size exclusion chromatography or liquid chromatography.

One or more steps of the above techniques can be performed under denaturing conditions, partially denaturing conditions, or non-denaturing conditions. The denaturing conditions can include conditions that cause denaturing of the nucleic acid transcript (e.g., mRNA) due to temperature, chaotropic agents (including salts), organic agents, among other mechanisms for denaturing. With thermal denaturing conditions, an elevated temperature can be applied. The elevated temperature can be one that is sufficient to denature intramolecular hydrogen bonds, to cause a change in or loss of secondary or tertiary structure, and so forth. For example, the temperature or thermal denaturing conditions can include a temperature of 25 degrees Celsius to 95 degrees Celsius, 35 to 85 degrees Celsius, 55 to 75 degrees Celsius, or of another range within those ranges. Similarly, higher or lower temperatures can be used as appropriate to cause the desired level of denaturing. The temperature or thermal denaturing conditions can also be dependent on the identity of the nucleic acid transcript, such that different temperatures are used for different nucleic acid transcripts or types of nucleic acid transcripts. The denaturing conditions can also include using chaotropic agents, such as lithium perchlorate and other perchlorate salts, guanidinium chloride and other guanidinium salts, urea, butanol, ethanol, lithium acetate, magnesium chloride, phenol, propanol, sodium dodecyl sulfate, thiourea, or others. The denaturing conditions can further include organic denaturing agents, such as dimethyl sulfoxide (DMSO), acetonitrile, and glyoxal. In addition, the denaturing conditions can include a combination of two or more of these types of denaturing conditions.

Any one or more of the steps of the RNA heterogeneity determining techniques can be performed at an elevated temperature or at ambient temperature, with or without chaotropic or organic agents.

a) Gel Electrophoresis

In some embodiments, RNA transcript topology and apparent (hydrodynamic) size can be analyzed by gel electrophoresis, such as agarose gel electrophoresis. In some examples, RNA transcript can be resolved on a 0.05% to 2% agarose gel, such as a 1.2% agarose gel, and visualized by staining or using probes that are specific to a particular sequence. In some embodiments, RNA transcripts can be directly assessed by gel electrophoresis, or can be assessed after amplification, such as quantitative amplification methods. Nucleic acid stains for visualizing nucleic acid on agarose gel are well known. Exemplary stains include BlueView™ Nucleic Acid Stain (Millipore Sigma), SYBR® Gold Nucleic Acid Stain (ThermoFisher), SYBR® Green Nucleic Acid Stain (Millipore Sigma), SYBR® Green II (ThermoFisher), PicoGreen® nucleic acid stain (Invitrogen), and ethidium bromide: 0.5 µg/mL prepared in distilled water, or incorporated into the gel. In some examples, the nucleic acid is stained using Quant-iT™ PicoGreen® binding followed by fluorescence detection and quantitation of the amplified products. The agarose gel method gives a more quantitative, but less resolving, measure of size distribution. In some embodiments, the nucleic acid fragments, resolved by agarose gel electrophoresis can be visualized by Northern blot for RNA or Southern blot for amplified reverse transcriptase-polymerase chain reaction (RT-PCR) products.

b) Chip-Based Capillary Electrophoresis

Chip-based capillary electrophoresis (e.g., with the AGILENT 2100 BIOANALYZER™) can be used a rapid and routine method for monitoring RNA transcript integrity and its size distribution. The separation is based on hydrodynamic size and charge, and is affected by the nucleotide length and folded structure of the RNA transcript. In one embodiment, the method includes delivering the sample into a channel of a chip with an electrolyte medium and applying an electric field to the chip that causes the RNA transcript and the impurities migrate through the channel. The RNA transcript has a different electrophoretic mobility than the impurities such that the RNA transcript migrates through the channel at rate that is different from a rate at which the impurities migrate through the channel. The electrophoretic mobility of the RNA transcript is proportional to an ionic charge the RNA transcript and inversely proportional to frictional forces in the electrolyte medium. The method also includes collecting from the chip the sample comprising the RNA transcript and one or more separate portions of the sample comprising the impurities. In addition, the method includes characterizing an aspect of at least one of the portion of the sample comprising the RNA transcript and the one or more separate portions of the sample comprising the impurities. The characterizing can include, for example, quantifying charge variants.

c) Analytical Ultracentrifugation (AUC)

Analytical ultracentrifugation (AUC) is a solution phase method for measuring molecular weight distribution, without the potential artifacts that could be introduced by matrix (resin or gel) interaction in the SEC, agarose, or other methods. Both equilibrium AUC and sedimentation ultracentrifugation are used, and the latter provides sedimentation coefficients that are related to both size and shape of the RNA transcript. A BECKMAN™ analytical ultracentrifuge equipped with a scanning UV/visible optics is used for analysis of the RNA transcript.

d) Field Flow Fractionation (FFF)

Another solution phase method for assessing hydrodynamic size distribution is field flow fractionation (FFF). FFF is a separation technique where a field is applied to a fluid suspension or solution pumped through a long and narrow channel, perpendicular to the direction of flow, to cause separation of the polynucleotides (RNA transcripts) present in the fluid, under the force exerted by the field. The field can be asymmetrical flow through a semipermeable membrane, gravitational, centrifugal, thermal-gradient, electrical, magnetic etc.

e) Chromatography

Chromatography also can be used to detect heterogeneity of RNA transcript lengths. Methods of size exclusion chromatography and liquid chromatography for determining mRNA heterogeneity are described in WO2014144711 which is incorporated herein by reference.

B. Methods of Optimizing Polynucleotides, e.g., Polynucleotides Encoding BCMA CARs In some embodiments, the provided methods include optimizing and/or modifying the polynucleotide, for example, to reduce RNA heterogeneity and/or removing or eliminating cryptic or undesired splice sites. In some aspects, provided are methods of reducing the heterogeneity of an expressed transgene transcript that involves identifying a transgene candidate for the removal of splice sites, such as by the methods described above in Section I.A.; identifying one or more potential splice donor and/or splice acceptor sites; and modifying the nucleic acid sequence at or near the one or more identified splice donor sites that were identified, thereby generating a modified polynucleotide. In some aspects, the methods also involve assessing the transgene candidacy for the removal of splice sites. In some embodiments, the methods also include repeating one or more steps above until the heterogeneity of the transcript is reduced compared to the initial heterogeneity of the transcript as determined (such as before modification).

In some embodiments, methods of reducing heterogeneity, such as by removal or elimination of predicted splice sites, can be performed after codon optimization, or on non codon-optimized RNA. In some aspects, the methods involve identifying splice sites, such as one or more potential splice donor and/or acceptor sites, and modifying or change the RNA sequence (e.g., by replacing or substituting one or more nucleotides at or near the splice site. In some embodiments, codon optimization can be performed prior to and/or after methods of reducing heterogeneity of transcribed RNA (e.g., mRNA), such as by removal or elimination of predicted splice sites. In some embodiments, whether a transcript is a candidate for reducing RNA heterogeneity is determined based on the method of measuring RNA heterogeneity, e.g., as described in Section II.A herein. In some aspects, a transcribed nucleic acid that is detected as having heterogeneity is identified as a transgene candidate for removal of one or more splice site. In some embodiments, a transgene sequence can be a candidate for reducing heterogeneity when the transcribed nucleic acid of the transgene candidate exhibits at least or at least about 5%, 10%, 15%, 20%, 25%, 30%, 40%, 45%, 50%, 55%, 60%, 65%, 70%, 75% or more heterogeneity following expression in a cell. In some embodiments, following transcription and processing of the polynucleotide in a human cell, optionally a human T cell, the messenger RNA (mRNA) from the polynucleotide, exhibits at least 70%, 75%, 80%, 85%, 90%, or 95% RNA homogeneity.

1. Methods of Reducing RNA Heterogeneity

Provided are methods of reducing heterogeneity of an expressed transgene transcript. In some embodiments, the methods involve identifying one or more potential splice donor and/or splice acceptor sites and modifying the nucleic acid sequence at or near the one or more of the identified splice donor sites. In some embodiments, the methods also involve assessing the transgene candidacy for removal of splice sites. In some aspects, one or more steps described herein can be repeated, for example, until the potential RNA heterogeneity is reduced compared to the starting or unmodified transcript.

a) Splice Site Identification

In some aspects, the presence of potential cryptic splice sites (splice donor and/or acceptor sites that are present in a transcript, such as a transgene transcript, can result in RNA heterogeneity of the transcript following expression in a cell. In some embodiments, the methods involve identifying one or more potential splice sites that can be present in the transgene transcript, that are not desired and/or that may be created in a transgene transcript from various underlying sequences, following codon optimization of a transcript and/or by mutation or mistake or error in transcription. In some aspects of the provided embodiments, the splice donor sites and splice acceptor sites are identified independently. In some embodiments, the splice acceptor and/or donor site(s) is/are canonical, non-canonical, and/or cryptic splice acceptor and/or donor site(s).

In some embodiments, the provided methods include identifying one or more potential splice site (e.g., canonical, non-canonical, and/or cryptic splice acceptor and/or donor site(s) or branch sites) in a polynucleotide, such as a polynucleotide encoding a transgene, such as a recombinant receptor, that may exhibit RNA heterogeneity or contain undesired. Also provided are polypeptides having reduced numbers of such splice sites as compared to such reference polynucleotides.

In some aspects, identification of the one or more splice sites in a nucleic acid sequence is an iterative process. In some embodiments, splice sites can be identified using a splice site and/or codon optimization prediction tool, such as by submitting the starting or reference sequence encoding the transgene, such as a BCMA-binding receptor, e.g., anti-BCMA CAR, to a database, a gene synthesis vendor or other source able to computationally or algorithmically compare the starting or reference sequence to identify or predict splice sites and/or for codon optimization and/or splice site removal. In some embodiments, after modifying the sequence for codon optimization and/or splice site removal, one or more further assessment of a sequence, such as a revised or modified nucleic acid sequence, is carried out to further evaluate for splice site removal, such as cryptic splice sites, using one or more other or additional splice site prediction tool(s).

In some aspects, RNA heterogeneity can be a result of the activity of the spliceosome present in a eukaryotic cell. In some aspects, splicing is typically carried out in a series of reactions catalyzed by the spliceosome. Consensus sequences for splice sites are known, but in some aspects, specific nucleotide information defining a splice site may be complex and may not be readily apparent based on available methods. Cryptic splice sites are splice sites that are not predicted based on the standard consensus sequences and are variably activated. Hence, variable splicing of pre-mRNA at cryptic splice sites leads to heterogeneity in the transcribed mRNA products following expression in eukaryotic cells. In some cases, within spliceosomal introns, a donor site (usually at the 5' end of the intron), a branch site (near the 3' end of the intron) and an acceptor site (3' end of the intron) are required for a splicing event. The splice donor site can include a GU sequence at the 5' end of the intron, with a large less highly conserved region. The splice acceptor site at the 3' end of the intron can terminate with an AG sequence.

In some embodiments, splice sites, including potential cryptic splice sites can be identified by comparing sequences to known splice site sequences, such as those in a sequence database. In some embodiments, splice sites can be identified by computationally by submitting nucleotide sequences for analysis by splice site prediction tools, such as Human Splice Finder (Desmet et al., Nucl. Acids Res. 37(9):e67 (2009)), a neural network splice site prediction tool, NNSplice (Reese et al., *J. Comput. Biol.*, 4(4):311 (1997)), GeneSplicer (Pertea et al., Nucleic Acids Res. 2001 29(5): 1185-1190) or NetUTR (Eden and Brunak, Nucleic Acids Res. 32(3):1131 (2004)), which identify potential splice sites and the probability of a splicing event at such sites. Additional splice prediction tools include RegRNA, ESEfinder, and MIT splice predictor. Splice site prediction tools such as GeneSplicer has been trained and/or tested successfully on databases for different species, such as human, *Drosophila melanogaster, Plasmodium falciparum, Arabidopsis thaliana*, and rice. In some embodiments, different prediction tools may be adapted for different extents on different database and/or for different species. In some embodiments, the one or more prediction tools are selected based upon their utility in certain database and/or for certain species. See, e.g., Saxonov et al., (2000) Nucleic Acids Res., 28, 185-190.

In some embodiments, one or more splice site prediction tools are selected for use in the determination of potential splice donor and/or acceptor sites. In some embodiments, splice site prediction tools that can be run locally; that can be retrained with a set of data at the user site; that can use databases for particular species (such as human), that can be compiled for multiple platforms, that allow real-time predictions for sequence selections, and/or that is an OSI certified open source software such that particular tools or plugins can be modified, can be employed. Exemplary tools that can be employed include NNSplice, GeneSplicer or both.

In some aspects, the splice site prediction tools be used to identify a list of potential splice donor and/or splice acceptor sites in a sequence such as a polynucleotide sequence containing transgene sequences. In some aspects, the prediction tools also can generate one or more prediction scores for one or more sequences in the polynucleotide, that can indicate the likelihoods of the one or more sequences being a splice donor or acceptor site sequence.

In some embodiments, the method involves comparing the prediction score for a particular splice site with a threshold score or reference score to determine or identify a particular splice sites that are candidate for elimination or removal. For example, in some embodiments, the predicted splice site is identified as a potential splice site when the prediction score is greater or no less than the threshold score or reference score. In some aspects, considerations for eliminating or removing a particular splice site include the prediction score as compared to a reference score or a threshold score; and whether a particular splice site is desired or intentional (for example, when the splicing event is more advantageous or is required for regulation of transcription and/or translation). In some aspects, the likelihood that the resulting splice variant loses the desired function or has compromised function can also be considered when determining particular donor and/or acceptor sites for elimination or removal. In some aspects, the one or more potential splice donor and/or splice acceptor sites exhibit a score about or at least about 0.7, 0.75, 0.8, 0.85, 0.9, 0.95, or 1.0 (e.g., on a scale with a maximum of 1.0) of a splice event or probability of a splice event, and the site can be a candidate for splice site elimination or removal. In some aspects, the score, e.g., used by GeneSplicer, at the one or more potential splice donor and/or splice site is based on the difference between the log-odds score returned for that sequence by the true Markov model and the score is computed by the false Markov model. In particular embodiments, the splice donor sites and splice acceptor sites are evaluated independently, or individually. In some embodiments, splice donor sites and splice acceptor sites are evaluated as a splice donor/acceptor pair.

b) Splice Site Elimination

In some embodiments, the provided methods involve eliminating or eliminating one or more splice donor and/or splice acceptor site(s), such as the potential splice donor and/or acceptor sites that may be involved in a cryptic splicing event that is not desired or that results in undesired RNA heterogeneity. In some embodiments, eliminating one or more splice sites comprises modifying one or more nucleotides (e.g., by substitution or replacement) in at, containing or near the splice donor and/or acceptor sites that are candidates for removal. In some aspects, a particular nucleotide within a codon that is at, contains or is near the splice site is modified (e.g., substituted or replaced). In some aspects, the modification (such as substitution or replacement) retains or preserves the amino acid encoded by the particular codon at the site, at the same time removing the potential splice donor and/or acceptor sites.

In some embodiments, the codon at or near the splice site for modification comprises one or more codons that involve one or both of the two nucleotides at the potential splice site (in some cases referred to as "splice site codon"). When the potential splicing is predicted to occur between two nucleotides in a codon, the codon is the only splice site codon for this splice site. If the potential splicing is predicted to occur between two adjacent codons, for example, between the last nucleotide of the first codon and the first nucleotide of the next codon, the two codons are splice site codons. For example, for splice sites that are predicted to be at boundaries of two codons, the two adjacent codons can be candidates for nucleotide modification. In some embodiments, the one or more codons comprise one splice site codon. In some embodiments, the one or more codons comprise both splice site codons. In some embodiments, the method involves eliminating potential splice donor site by modifying one or both splice site codons. In some embodiments, the method involves eliminating a potential splice acceptor donor site by modifying one or both splice site codons. In some embodiments, the one or both codons at the splice site is not modified, for example, when there are no synonymous codon for the splice site codon. In some embodiments, if there are no synonymous codons available for the particular splice site codon, one or more nucleotides in a nearby codon can be modified. In some embodiments, one or more codons that are modified include a splice site codon, wherein the modification comprises changing one or both nucleotides at the splice site to a different nucleotide or different nucleotides. In some embodiments, In some embodiments, the method involves eliminating the splice donor site by modifying one or both splice site codons, wherein the modification does not change one or two of the nucleotides of the at the splice site to a different nucleotide, but a nearby nucleotide, e.g., a part of a codon adjacent to the splice site, is modified. In some embodiments, the nearby or adjacent nucleotides that can be modified include modification of a nucleotide that is a part of a nearby or adjacent codon, such as a codon that is within one, two, three, four, five, six, seven, eight, nine or ten codons upstream or downstream of the splice site codon.

In some cases, manual modification of the polynucleotides can be employed, while preserving the encoded amino acid sequence, to reduce the probability of a predicted splice site. In some embodiments, one or more of the predicted splice sites having at least 80%, 85%, 90%, or 95% probability of a splice site are manually modified to reduce the probability of the splicing event. In some embodiments, the one or more modification(s) is/are by nucleotide replacement or substitution of 1, 2, 3, 4, 5, 6 or 7 nucleotides. In some embodiments, the modification(s) is/are at the junction of the splice donor site or are at the junction of the splice acceptor site. In some embodiments, at least one of the one or more nucleotide modifications is within 1, 2, 3, 4, 5, 6, 7, 8, 9 or 10 residues of the splice site junction of the splice acceptor and/or splice donor site. In some embodiments, libraries of modified nucleic acid sequences can be generated with reduced probability of cryptic splice sites. In some embodiments, splice donor sites and splice acceptor sites are evaluated as a splice donor/acceptor pair. In particular embodiments, the splice donor sites and splice acceptor sites are evaluated independently, or individually, and not part as a splice donor/acceptor pair. In some embodiments, one or more predicted splice sites are not eliminated. In some embodiments, splice sites, such as known or predicted splice sites, within the promoter region of the transcript are not eliminated.

In some embodiments, the method involves eliminating one or more potential donor splice site by modifying one or two splice site codons or one or more nearby or adjacent codons (for example, if a synonymous codon is not available for the splice site codon). In some embodiments, the method involves eliminating one or more potential acceptor splice site by modifying one or two splice site codons or one or more nearby or adjacent codons (for example, if a synonymous codon is not available for the splice site codon). In some embodiments, the nearby or adjacent codon that is subject to modification include a codon that is within one, two, three, four, five, six, seven, eight, nine or ten codons upstream or downstream of the splice site codon, such as a codon that is within one, two or three codons from the splice site. In some embodiments, the methods can include removal or elimination of a potential branch site for splicing. In some aspects, a nucleotide within the codon at or near the branch site can be modified, e.g., substituted or replaced, to eliminate cryptic splicing and/or reduce RNA heterogeneity. In some embodiments, the modification of the one or more nucleotides can involve a substitution or replacement of one of the nucleotides that may be involved in splicing (such as at the splice donor site, splice acceptor site or splice branch site), such that the amino acid encoded by the codon is preserved, and the nucleotide substitution or replacement does not change the polypeptide sequence that is encoded by the polynucleotide. In some cases, the third position in the codon is more degenerate than the other two positions. Thus, various synonymous codons can encode a particular amino acid (see, e.g., Section II.B.2 below). In some embodiments, the modification includes replacing the codon with a synonymous codon used in the species of the cell into which the polynucleotide is introduced (e.g., human). In some embodiments, the species is human. In some embodiments, the one or more codon is replaced with a corresponding synonymous codons that the most frequently used in the species or synonymous codons that have a similar frequency of usage (e.g., most closest frequency of usage) as the corresponding codon (see, e.g., Section II.B.2 below).

In some embodiments, the methods also involve assessing the transgene candidacy for the removal of splice sites, after initial proposed modification. In some aspects, the proposed modification can be evaluated again, to assess the proposed modification and identify any further potential splice sites after modification and/or codon optimization. In some aspects, after modifying the sequence for codon optimization and/or splice site removal, one or more further assessment of a sequence, such as a revised or modified nucleic acid sequence, is carried out to further evaluate for splice site removal, such as cryptic splice sites, using the same or one or more other or additional splice site prediction tool(s). In some aspects, proposed modifications are considered for subsequent steps, and iterative optimization can be used. In some aspects, the methods also include repeating any of the identification and/or modification step, for example, until heterogeneity of the transcript is reduced compared to the heterogeneity of the transcript as initially determined. In some embodiments, a further or a different modification, such as with a different nucleotide replacement at the same codon or a modification at a different position or codon, can be done after an interactive evaluation and assessment. In some embodiments, corresponding different synonymous codon can be used, such as the second most frequently used in the particular species or a codon that has a similar frequency of usage (e.g., the next closest frequency of usage) as the corresponding codon (see, e.g., Section II.B.2 below).

In some aspects, a proposed modification can be further evaluated, for example, to assess whether the modification generates an undesired or additional restriction site in the polynucleotide. In some aspects, an additional restriction site may not be desired, and a further or a different modification (e.g., with a different nucleotide replacement at the same codon or a modification at a different position or codon) can be considered. In some aspects, particular restriction site, such as a designated restriction site, is avoided. In some aspects, if the modification does not substantially reduce or, the splice site prediction score, an additional or alternative modification can be proposed. In some embodiments, the splice site prediction score can be is reduced or lowered by at least about 5%, 10%, 15%, 20%, 25%, 30%, 35%, 40%, 45%, 50%, 55%, 60%, 65%, 70% or 75%, after one or more iteration of the methods.

In some embodiments of any of the methods provided herein, a computer system can be used to execute one or more steps, tools, functions, processes or scripts. In certain embodiments, methods provided herein are computer implemented methods and/or are performed with the aid of a computer. In some embodiments, the splice site prediction, evaluation and modification for elimination or removal of a splice site can be performed by computer implemented methods and/or by methods which include steps that are computer implemented steps. In some embodiments, comparison of the sequences to a known database, calculating a splice site prediction score, determining potential nucleotide modifications, codon optimization and/or any one of the iterative steps can be implemented by a computer or using a computer-implemented steps, tools, functions, processes or scripts. In particular embodiments, a computer system comprising a processor and memory is provided, wherein the memory contains instructions operable to cause the processor to carry out any one or more of steps of the methods provided herein. In some embodiments, the methods include steps, functions, processes or scripts that are performed computationally, e.g., performed using one or more computer programs and/or via the use of computational algorithms.

Exemplary steps, functions, processes or scripts of the provided methods for identifying and/or removing possible splice sites include one or more steps of: selecting sequence, writing FASTA format sequences, loading codon table (e.g., from www.kazusa.or.jp/codon, running GeneSplicer, loading predictions, parsing codons, determining overlaps in prediction, identifying next highest usage synonymous codon, reviewing for restriction site, creating annotations or assessing other codons. Particular steps can assess both forward and reverse strands. In some aspects, previously annotated splice site modifications can also be considered, to allow for iterative optimization. In some embodiments, any one or more of the steps, functions, processes or scripts can be repeated.

In certain embodiments, methods provided herein may be practiced, at least in part, with computer system configurations, including single-processor or multi-processor computer systems, minicomputers, mainframe computers, as well as personal computers, hand-held computing devices, microprocessor-based and/or programmable consumer electronics and the like, each of which may operatively communicate with one or more associated devices. In particular embodiments, the methods provided herein may be practiced, at least in part, in distributed computing environments such that certain tasks are performed by remote processing devices that are linked through a communications network. In a distributed computing environment, program modules may be located in local and/or remote memory storage devices. In particular embodiments, some or all steps of the methods provided herein may be practiced on stand-alone computers.

In particular embodiments, some or all of the steps of the methods provided herein can operate in the general context of computer-executable instructions, such as program modules, plugins and/or scripts executed by one or more components. Generally, program modules include routines, programs, objects, data structures and/or scripts, that perform particular tasks or implement particular abstract data types. Typically, the functionality of the program modules may be combined or distributed as desired. In certain embodiments, instructions operable to cause the processor to carry out any one or more steps of the methods provided herein can be embodied on a computer-readable medium having computer-executable instructions and transmitted as signals manufactured to transmit such instructions as well as the results of performing the instructions, for instance, on a network. In some embodiments, also provided are computer systems, computer readable instructions, software, systems, networks and/or devices for carrying out or performing one or more steps of the methods provided herein.

2. Codon Optimization

In some embodiments the polynucleotides are modified by optimization of the codons for expression in humans. In some aspects, codon optimization can be considered before and/or after the steps for splice site identification and/or splice site elimination, and/or at each of the iterative steps for reducing RNA heterogeneity. Codon optimization generally involves balancing the percentages of codons selected with the abundance, e.g., published abundance, of human transfer RNAs, for example, so that none is overloaded or limiting. In some cases, such balancing is necessary or useful because most amino acids are encoded by more than one codon, and codon usage generally varies from organism to organism. Differences in codon usage between transfected or transduced genes or nucleic acids and host cells can have effects on protein expression from the nucleic acid molecule. Table 3 below sets forth an exemplary human codon usage frequency table. In some embodiments, to generate codon-optimized nucleic acid sequences, codons are chosen to select for those codons that are in balance with human usage frequency. The redundancy of the codons for amino acids is such that different codons code for one amino acid, such as depicted in Table 3. In selecting a codon for replacement, it is desired that the resulting mutation is a silent mutation such that the codon change does not affect the amino acid sequence. Generally, the last nucleotide of the codon (e.g., at the third position) can remain unchanged without affecting the amino acid sequence.

TABLE 3

Human Codon Usage Frequency

| Human codon | amino acid | freq./1000 | number | Human codon | amino acid | freq./1000 | number |
|---|---|---|---|---|---|---|---|
| TTT | F | 17.6 | 714298 | TCT | S | 15.2 | 618711 |
| TTC | F | 20.3 | 824692 | TCC | S | 17.7 | 718892 |
| TTA | L | 7.7 | 311881 | TCA | S | 12.2 | 496448 |
| TTG | L | 12.9 | 525688 | TCG | S | 4.4 | 179419 |
| CTT | L | 13.2 | 536515 | CCT | P | 17.5 | 713233 |
| CTC | L | 19.6 | 796638 | CCC | P | 19.8 | 804620 |
| CTA | L | 7.2 | 290751 | CCA | P | 16.9 | 688038 |
| CTG | L | 39.6 | 1611801 | CCG | P | 6.9 | 281570 |
| ATT | I | 16 | 650473 | ACT | T | 13.1 | 533609 |
| ATC | I | 20.8 | 846466 | ACC | T | 18.9 | 768147 |
| ATA | I | 7.5 | 304565 | ACA | T | 15.1 | 614523 |
| ATG | M | 22 | 896005 | ACG | T | 6.1 | 246105 |
| GTT | V | 11 | 448607 | GCT | A | 18.4 | 750096 |
| GTC | V | 14.5 | 588138 | GCC | A | 27.7 | 1127679 |
| GTA | V | 7.1 | 287712 | GCA | A | 15.8 | 643471 |
| GTG | V | 28.1 | 1143534 | GCG | A | 7.4 | 299495 |
| TAT | Y | 12.2 | 495699 | TGT | C | 10.6 | 430311 |
| TAC | Y | 15.3 | 622407 | TGC | C | 12.6 | 513028 |
| TAA | * | 1 | 40285 | TGA | * | 1.6 | 63237 |
| TAG | * | 0.8 | 32109 | TGG | W | 13.2 | 535595 |
| CAT | H | 10.9 | 441711 | CGT | R | 4.5 | 184609 |
| CAC | H | 15.1 | 613713 | CGC | R | 10.4 | 423516 |
| CAA | Q | 12.3 | 501911 | CGA | R | 6.2 | 250760 |
| CAG | Q | 34.2 | 1391973 | CGG | R | 11.4 | 464485 |
| AAT | N | 17 | 689701 | AGT | S | 12.1 | 493429 |
| AAC | N | 19.1 | 776603 | AGC | S | 19.5 | 791383 |
| AAA | K | 24.4 | 993621 | AGA | R | 12.2 | 494682 |
| AAG | K | 31.9 | 1295568 | AGG | R | 12 | 486463 |
| GAT | D | 21.8 | 885429 | GGT | G | 10.8 | 437126 |
| GAC | D | 25.1 | 1020595 | GGC | G | 22.2 | 903565 |
| GAA | E | 29 | 1177632 | GGA | G | 16.5 | 669873 |
| GAG | E | 39.6 | 1609975 | GGG | G | 16.5 | 669768 |

For example, the codons TCT, TCC, TCA, TCG, AGT and AGC all code for Serine (note that T in the DNA equivalent to the U in RNA). From a human codon usage frequency, such as set forth in Table 3 above, the corresponding usage frequencies for these codons are 15.2, 17.7, 12.2, 4.4, 12.1, and 19.5, respectively. Since TCG corresponds to 4.4%, if this codon were commonly used in a gene synthesis, the tRNA for this codon would be limiting. In codon optimization, the goal is to balance the usage of each codon with the normal frequency of usage in the species of animal in which the transgene is intended to be expressed.

C. Optimized Anti-BCMA CAR

In some embodiments, a starting or reference sequence encoding a transgene, such as a BCMA-binding receptor, e.g., anti-BCMA CAR, is assessed for codon optimization and/or splice site removal.

In some embodiments, the methods are carried out on an anti-BCMA CAR, such as a CAR containing an scFv antigen-binding domain specific to BCMA, a spacer, such as a spacer set forth in SEQ ID NO:649, a costimulatory signaling region, such as a costimulatory signaling domain from 4-1BB and a CD3 zeta signaling region. Exemplary identified splice donor sites and splice acceptor sites, and their corresponding scores, are listed in Tables 3 and 4 below for exemplary anti-BCMA CARs.

TABLE 4

Predicted Splice Donor Sites

| Region of Construct | STARTING SEQUENCE | | | O/SSE SEQUENCE | | |
|---|---|---|---|---|---|---|
| | splice donor site | SEQ ID NO | Splice score | optimized splice donor site | SEQ ID NO | Splice score |
| promoter | cgtctaggtagttt | 689 | 1 | no change | | <0.7 |
| scFv-encoding | | | | | | |
| BCMA-23 | gaccaaggtgaccgt | 690 | N/A | caccaaggtgaccgt | 698 | 0.54 |
| BCMA-26 | tgcactggtaccagc | 691 | 0.55 | no change | | |
| BCMA-52 | taaactggtaccagc | 692 | 0.76 | tgaactggtatcagc | 699 | <0.7 |
| BCMA-52 | atctctgtacgggt | 693 | 0.79 | atctcttgaaatggt | 700 | <0.7 |
| BCMA-52 | ggtcaaggtactctg | 694 | 0.85 | ggccagggcacactg | 701 | <0.7 |
| BCMA-55 | gaggacagtaagcgg | 695 | 0.66 | gaggacagcaagagg | 702 | <0.5 |
| BCMA-55 | ggtcaaggtactctg | 696 | 0.85 | ggccagggaaccctg | 703 | <0.5 |
| BCMA-55 | tgcctccgtgtctgc | 697 | <0.50 | tgccagcgttagtgc | 704 | 0.60 |
| Spacer-encoding | | | | | | |
| | aatctaagtacggac | 705 | 0.65 | agtctaaatacggac | 661 | <0.7 |
| | tcaactggtacgtgg | 706 | 0.96 | tcaactggtatgtgg | 662 | <0.7 |
| | tcaattggtacgtgg | 616 | 0.97 | tcaactggtatgtgg | 662 | <0.7 |
| | acaattagtaaggca | 707 | 0.43 | accatctccaaggcc | 663 | <0.7 |
| | accacaggtgtatac | 708 | 0.42 | gccccaggtttacac | 664 | <0.7 |
| CD3zeta signaling region-encoding | tttccaggtccgccg | 709 | 0.74 | tcagcagatccgccg | 665 | <0.7 |
| Truncated receptor surrogate marker-encoding | | | | | | |
| | ctgctctgtgagtta | 710 | 0.56 | ctcctgtgtgaactc | 666 | <0.7 |
| | acgcaaagtgtgtaa | 711 | 0.5 | tcggaaagtgtgcaa | 667 | <0.7 |
| | caacatggtcagttt | 712 | 0.71 | cagcacggccagttt | 668 | <0.7 |
| | aacagaggtgaaaac | 713 | 0.42 | aaccggggcgagaac | 669 | <0.7 |
| | ctggaggtgagcca | 714 | 0.82 | ctggaaggcgagccc | 670 | <0.7 |
| | tcttcatgtgagcgg | 720 | 0.84 | tgttcatgtgagcgg | 671 | <0.7 |
| Promoter | | | | | | |
| | tggctccgccttttcccgag ggtggggagaaccgtatat | 721 | 0.50 | no change | | |
| | tgaactgcgtccgccgtctag gtaagtttaaagctcaggtc | 722 | 0.71 | no change | | |
| | ttctgttctgcgccgttacag atccaagctgtgaccggcgc | 723 | 0.89 | no change | | |

TABLE 4-continued

Predicted Splice Donor Sites

| Region of Construct | STARTING SEQUENCE | | | O/SSE SEQUENCE | | |
|---|---|---|---|---|---|---|
| | splice donor site | SEQ ID NO | Splice score | optimized splice donor site | SEQ ID NO | Splice score |
| scFv-encoding | | | | | | |
| BCMA-23 | ctactacatgagctggatccg ccaggctccagggaaggggc | 724 | N/A | ctactatatgtcctggatcag acaggcacctggcaagggcc | 735 | 0.46 |
| BCMA-23 | ggctgattattattgtagctc atatggaggtagtaggtctt | 725 | N/A | ggcagattactattgttctag ctacggcggcagcagatcct | 736 | 0.55 |
| BCMA-25 | ctatgccatgtcctggttcag gcaggcaccaggcaagggcc | 726 | 0.95 | ctatgccatgtcctggttcaa gcaggcaccaggcaagggcc | 737 | <0.7 |
| BCMA-25 | gtccgcctctgtgggcgatag ggtgaccgtgacatgtcgcg | 727 | 0.50 | no change | | |
| BCMA-25 | gtgggctttatccgctctaaa gcctacggcggcaccacaga | 728 | 0.55 | no change | | |
| BCMA-25 | gtgacatgtcgcgcctccag ggcatctctaactacctggc | 729 | 0.67 | no change | | |
| BCMA-25 | tacagcgcctccaccctgcag agcggagtgccctcccggtt | 730 | 0.66 | no change | | |
| BCMA-52 | ctggccatcagtggcctccag tctgaggatgaggctgatta | 731 | <0.50 | ctggctatttctggactgcag agcgaggacgaggccgacta | 738 | 0.62 |
| BCMA-52 | agatacagcccgtccttccaa ggccacgtcaccatctcagc | 732 | <0.50 | agatacagccctagctttcag ggccacgtgaccatcagcgc | 739 | 0.67 |
| BCMA-55 | cgaggctgattattactgcag ctcaaatacaagaagcagca | 733 | 0.79 | cgaggccgattactactgcag cagcaacacccggtccagca | 740 | <0.40 |
| BCMA-55 | gccctcaggggtttctaatag cttctctggctccaagtctg | 734 | <0.50 | gcccagcggcgtgtccaatag attcagcggcagcaagagcg | 741 | 0.40 |
| Spacer-encoding | | | | | | |
| | cgccttgtcctccttgtccag ctcctcctgttgccggacct | 765 | 0.84 | cgccttgtcctccttgtccag ctcctcctgttgccggacct | 766 | <0.7 |
| | aagtttctttctgtattccag gctgaccgtggataaatctc | 742 | 0.97 | cagtttcttcctgtatagtag actcaccgtggataaatcaa | 672 | <0.7 |
| | aagtttctttctgtattccag gctgaccgtggataaatctc | 742 | 0.97 | aagtttctttctgtattccag actgaccgtggataaatctc | 854 | |
| | gggcaacgtgttctcttgcag tgtcatgcacgaagccctgc | 743 | 0.55 | gggcaacgtgttcagctgcag cgtgatgcacgaggccctgc | 673 | <0.7 |
| | cagtttcttcctgtatagtag actcaccgtggataaatcaa | 767 | 0.74 | No change | | |
| CD28 TM-encoding | aggggtgctggcctgttacag cctgctggtgacagtcgctt | 744 | 0.4 | cggagtgctggcctgttacag cctgctggttaccgtggcct | 674 | 0.75 |
| 4-1BB/ CD3zeta signaling region-encoding | gctgagagtcaagttttccag gtccgccgacgctccagcct | 745 | 0.55 | gctgagagtgaagttcagcag atccgccgacgctccagcct | 675 | <0.7 |
| Truncated Receptor Surrogate Marker-encoding | | | | | | |
| | actcctcctctggatccacag gaactggatattctgaaaac | 746 | 0.74 | acacctccactggatccccaa gagctggatatcctgaaaac | 676 | <0.7 |
| | acagggttttgctgattcag gcttggcctgaaaacaggac | 747 | 0.73 | accggattcctcctgatccaa gcctggccagagaacagaac | 677 | <0.7 |

TABLE 4-continued

Predicted Splice Donor Sites

| Region of Construct | STARTING SEQUENCE | | | O/SSE SEQUENCE | | |
|---|---|---|---|---|---|---|
| | splice donor site | SEQ ID NO | Splice score | optimized splice donor site | SEQ ID NO | Splice score |
| | accggattcctcctgattcaggcctggccagagaacagaac | 768 | 0.82 | accggattcctcctgatccaagcctggccagagaacagaac | 677 | <0.7 |
| | atggtcagttttctcttgcagtcgtcagcctgaacataaca | 748 | 0.89 | acggccagtttagcctggctgtggtgtctctgaacatcacc | 678 | <0.7 |

In some embodiments, the resulting modified nucleic acid sequence(s) is/are then synthesized and used to transduce cells to test for splicing as indicated by RNA heterogeneity. Exemplary methods are as follows and described in the Examples. Briefly, RNA is harvested from the expressing cells, amplified by reverse transcriptase polymerase chain reaction (RT-PCR) and resolved by agarose gel electrophoresis to determine the heterogeneity of the RNA, compared to the starting sequence. In some cases, improved sequences can be resubmitted to the gene synthesis vendor for further codon optimization and splice site removal, followed by further cryptic splice site evaluation, modification, synthesis and testing, until the RNA on the agarose gel exhibits minimal RNA heterogeneity.

In some embodiments, the provided methods for optimizing a coding nucleic acid sequence encoding a transgene, such as an anti-BCMA CAR provided herein, or a construct provided herein, is to both reduce or eliminate cryptic splice sites (see, e.g., SEQ ID NO: 622 for an exemplary codon optimized and splice site eliminated spacer sequence) and optimize human codon usage (see, e.g., SEQ ID NO: 855 for an exemplary codon optimized and spacer sequence). An exemplary optimization strategy is described in the Examples.

In some embodiments, provided are polynucleotides encoding a chimeric antigen receptor, comprising nucleic acid encoding: (a) an extracellular antigen-binding domain that specifically recognizes BCMA, including any of the antigen-binding domains described below; (b) a spacer of at least 125 amino acids in length; (c) a transmembrane domain; and (d) an intracellular signaling region, wherein following expression of the polynucleotide in a cell, the transcribed RNA, optionally messenger RNA (mRNA), from the polynucleotide, exhibits at least 70%, 75%, 80%, 85%, 90%, or 95% RNA homogeneity. In some embodiments the antigen-binding domain comprises a $V_H$ region and a $V_L$ region comprising the amino acid sequence set forth in SEQ ID NOs:617 and 618, respectively, or a sequence of amino acids having at least 90% identity to SEQ ID NOS:617 and 618, respectively. In some embodiments, the antigen-binding domain comprises a $V_H$ region that is or comprises a CDR-H1, CDR-H2 and CDR-H3 contained within the $V_H$ region amino acid sequence selected from SEQ ID NO: 617; and a $V_L$ region that is or comprises a CDR-L1, CDR-L2 and CDR-L3 contained within the $V_L$ region amino acid sequence selected from SEQ ID NO: 618. In some embodiments, In some embodiments, the antigen-binding domain comprises a $V_H$ region comprising a CDR-H1, CDR-H2, and CDR-H3 comprising the amino acid sequence of SEQ ID NOS:593, 594, and 595, respectively, and a $V_L$ region comprising a CDR-L1, CDR-L2, and CDR-L3 comprising the amino acid sequence of SEQ ID NOS:601, 602, and 603, respectively; or a $V_H$ region comprising a CDR-H1, CDR-H2, and CDR-H3 comprising the amino acid sequence of SEQ ID NOS:596, 597, and 595, respectively, and a $V_L$ region comprising a CDR-L1, CDR-L2, and CDR-L3 comprising the amino acid sequence of SEQ ID NOS:601, 602, and 603, respectively; or a $V_H$ region comprising a CDR-H1, CDR-H2, and CDR-H3 comprising the amino acid sequence of SEQ ID NOS: 598, 599, and 595, respectively, and a $V_L$ region comprising a CDR-L1, CDR-L2, and CDR-L3 comprising the amino acid sequence of SEQ ID NOS:601, 602, and 603, respectively; or a $V_H$ region comprising a CDR-H1, CDR-H2, and CDR-H3 comprising the amino acid sequence of SEQ ID NOS: 611, 612, and 613, respectively, and a $V_L$ region comprising a CDR-L1, CDR-L2, and CDR-L3 comprising the amino acid sequence of SEQ ID NOS: 614, 615, and 603, respectively; or a $V_H$ region that is or comprises the amino acid sequence set forth in SEQ ID NO: 617; and a $V_L$ region that is or comprises the amino acid sequence set forth in SEQ ID NO: 618. In some embodiments, exemplary antigen-binding domain in the chimeric antigen receptor encoded by the polynucleotide include those described in each row of Table 2 herein. In any of such embodiments, the transmembrane domain of the CAR is or comprises a transmembrane domain derived from a CD28; the intracellular signaling region comprises a cytoplasmic signaling domain of a CD3-zeta (CD3ζ) chain or a functional variant or signaling portion thereof and a costimulatory signaling region comprises an intracellular signaling domain of 4-1BB.

In some embodiments, provided are polynucleotides encoding a chimeric antigen receptor, comprising nucleic acid encoding: (a) an extracellular antigen-binding domain that specifically recognizes BCMA, including any of the antigen-binding domains described below; (b) (b) a spacer, wherein the encoding nucleic acid is or comprises, or consists or consists essentially of, the sequence set forth in SEQ ID NO:622 or encodes a sequence of amino acids set forth in SEQ ID NO:649; (c) a transmembrane domain; and (d) an intracellular signaling region. In some embodiments the antigen-binding domain comprises a $V_H$ region and a $V_L$ region comprising the amino acid sequence set forth in SEQ ID NOs:617 and 618, respectively, or a sequence of amino acids having at least 90% identity to SEQ ID NOS:617 and 618, respectively. In some embodiments, the antigen-binding domain comprises a $V_H$ region that is or comprises a CDR-H1, CDR-H2 and CDR-H3 contained within the $V_H$ region amino acid sequence selected from SEQ ID NO: 617; and a $V_L$ region that is or comprises a CDR-L1, CDR-L2 and CDR-L3 contained within the $V_L$ region amino acid sequence selected from SEQ ID NO: 618. In some embodiments, In some embodiments, the antigen-binding domain comprises a $V_H$ region comprising a CDR-H1, CDR-H2, and CDR-H3 comprising the amino acid sequence of SEQ ID NOS:593, 594, and 595, respectively, and a $V_L$ region comprising a CDR-L1, CDR-L2, and CDR-L3 comprising the amino acid sequence of SEQ ID NOS:601, 602, and 603, respectively; or a $V_H$ region comprising a CDR-H1, CDR-H2, and CDR-H3 comprising the amino acid sequence of SEQ ID NOS:596, 597, and 595, respectively, and a $V_L$ region comprising a CDR-L1, CDR-L2, and CDR-L3 comprising the amino acid sequence of SEQ ID NOS:601, 602, and 603, respectively; or a $V_H$ region comprising a CDR-H1, CDR-H2, and CDR-H3 comprising the amino acid sequence of SEQ ID NOS: 598, 599, and 595, respectively, and a $V_L$ region comprising a CDR-L1, CDR-L2, and CDR-L3 comprising the amino acid sequence of SEQ ID NOS:601, 602, and 603, respectively; or a $V_H$ region comprising a CDR-H1, CDR-H2, and CDR-H3 comprising the amino acid sequence of SEQ ID NOS: 611, 612, and 613, respectively, and a $V_L$ region comprising a CDR-L1, CDR-L2, and CDR-L3 comprising the amino acid sequence of SEQ ID NOS: 614, 615, and 603, respectively; or a $V_H$ region that is or comprises the amino acid sequence set forth in SEQ ID NO: 617; and a $V_L$ region that is or comprises the amino acid sequence set forth in SEQ ID NO: 618. In some embodiments, exemplary antigen-binding domain in the chimeric antigen receptor encoded by the polynucleotide include those described in each row of Table 2 herein. In any of such embodiments, the transmembrane domain of the CAR is or comprises a transmembrane domain derived from a CD28; the intracellular signaling region comprises a cytoplasmic signaling domain of a CD3-zeta (CD3ζ) chain or a functional variant or signaling portion thereof and a costimulatory signaling region comprises an intracellular signaling domain of 4-1BB.

Also provided herein are exemplary modified polynucleotides, including polynucleotides that were modified for codon optimization (0) and/or splice site elimination (SSE). Examples of such polynucleotides are set forth in Table 5, wherein exemplary nucleotide (nt) sequences for the components of the exemplary CAR constructs prior to splice site elimination and codon optimization (non-opt), nucleic acid (nt) sequences for the components of the CAR constructs following splice site elimination and optimization (O/SSE), and the corresponding amino acid (aa) sequences encoded by the nucleic acid sequences are provided. The components include the IgG-kappa signaling sequence (ss), the anti-BCMA scFv, spacer region, transmembrane (tm) domain, co-signaling sequence (4-1BB co-sig or CD28 co-sig), CD3-ζ signaling domain (CD3-ζ), T2A ribosomal skip element (T2A) and truncated EGF receptor (EGFRt) sequence. Polynucleotide sequences of exemplary CAR constructs are set forth in SEQ ID NOs: 751-756, encoding the amino acid sequences set forth in SEQ ID NOs: 757-762.

TABLE 5

Exemplary BCMA CAR components (SEQ ID NOs)

| Construct | Sequence | ss | scFv | spacer | TM | 4-1BB co-stim | CD3-ζ |
|---|---|---|---|---|---|---|---|
| BCMA-23-L CAR | non-opt (nt) | 619 | 352 | 621 | 623 | 625 | 627 |
| BCMA-23-L CAR CO/SSE | O/SSE (nt) | 684 | 715 | 622 or 856 | 688 | 681 | 652 |
| both | aa | 620 | 278 | 649 | 624 | 626 | 628 |
| BCMA-25-L CAR | non-opt (nt) | 619 | 716 | 621 | 623 | 625 | 627 |
| BCMA-25-L CAR CO/SSE | O/SSE (nt) | 682 | 717 | 622 or 856 | 688 | 681 | 652 |
| both | Aa | 620 | 559 | 649 | 624 | 626 | 628 |
| BCMA-26-L CAR | non-opt (nt) | 619 | 718 | 621 | 623 | 625 | 627 |
| BCMA-26-L CAR CO/SSE | O/SSE (nt) | 685 | 719 | 622 or 856 | 688 | 681 | 652 |
| both | aa | 620 | 560 | 649 | 624 | 626 | 628 |
| BCMA-52-L CAR | non-opt (nt) | 619 | 647 | 621 | 623 | 625 | 627 |
| BCMA-52-L CAR CO/SSE | O/SSE (nt) | 682 | 440 | 622 or 856 | 688 | 681 | 652 |
| both | Aa | 620 | 442 | 649 | 624 | 626 | 628 |
| BCMA-55-L CAR | non-opt (nt) | 619 | 648 | 621 | 623 | 625 | 627 |
| BCMA-55-L CAR CO/SSE | O/SSE (nt) | 683 | 460 | 622 or 856 | 688 | 681 | 652 |
| both | aa | 620 | 478 | 649 | 624 | 626 | 628 |
| | | | | | | CD28 co-stim | |
| BCMA-55-L-CD28 CAR | non-opt (nt) | 619 | 648 | 621 | 623 | 679 | 627 |
| BCMA-55-L-CD28 CAR CO/SSE | O/SSE (nt) | 683 | 460 | 622 | 688 | 679 | 652 |
| both | aa | 620 | 478 | 649 | 624 | 680 | 628 |

III. ENGINEERED CELLS

Also provided are cells such as engineered cells that contain a recombinant receptor (e.g., a chimeric antigen receptor) such as one that contains an extracellular domain including an anti-BCMA antibody or fragment as described herein. Also provided are populations of such cells, compositions containing such cells and/or enriched for such cells, such as in which cells expressing the BCMA-binding molecule make up at least 50, 60, 70, 80, 90, 91, 92, 93, 94, 95, 96, 97, 98, 99, or more percent of the total cells in the composition or cells of a certain type such as T cells or CD8+ or CD4+ cells. Among the compositions are pharmaceutical compositions and formulations for administration, such as for adoptive cell therapy. Also provided are therapeutic methods for administering the cells and compositions to subjects, e.g., patients.

Thus also provided are genetically engineered cells expressing the recombinant receptors containing the antibodies, e.g., cells containing the CARs. The cells generally are eukaryotic cells, such as mammalian cells, and typically are human cells. In some embodiments, the cells are derived from the blood, bone marrow, lymph, or lymphoid organs, are cells of the immune system, such as cells of the innate or adaptive immunity, e.g., myeloid or lymphoid cells, including lymphocytes, typically T cells and/or NK cells.

Other exemplary cells include stem cells, such as multipotent and pluripotent stem cells, including induced pluripotent stem cells (iPSCs). The cells typically are primary cells, such as those isolated directly from a subject and/or isolated from a subject and frozen. In some embodiments, the cells include one or more subsets of T cells or other cell types, such as whole T cell populations, CD4+ cells, CD8+ cells, and subpopulations thereof, such as those defined by function, activation state, maturity, potential for differentiation, expansion, recirculation, localization, and/or persistence capacities, antigen-specificity, type of antigen receptor, presence in a particular organ or compartment, marker or cytokine secretion profile, and/or degree of differentiation. With reference to the subject to be treated, the cells may be allogeneic and/or autologous. Among the methods include off-the-shelf methods. In some aspects, such as for off-the-shelf technologies, the cells are pluripotent and/or multipotent, such as stem cells, such as induced pluripotent stem cells (iPSCs). In some embodiments, the methods include isolating cells from the subject, preparing, processing, culturing, and/or engineering them, as described herein, and re-introducing them into the same patient, before or after cryopreservation.

Among the sub-types and subpopulations of T cells and/or of CD4+ and/or of CD8+ T cells are naïve T ($T_N$) cells, effector T cells ($T_{EFF}$), memory T cells and sub-types thereof, such as stem cell memory T ($T_{scM}$), central memory T ($T_{O4}$), effector memory T ($T_{EM}$), or terminally differentiated effector memory T cells, tumor-infiltrating lymphocytes (TIL), immature T cells, mature T cells, helper T cells, cytotoxic T cells, mucosa-associated invariant T (MAIT) cells, naturally occurring and adaptive regulatory T (Treg) cells, helper T cells, such as TH1 cells, TH2 cells, TH3 cells, TH17 cells, TH9 cells, TH22 cells, follicular helper T cells, alpha/beta T cells, and delta/gamma T cells.

In some embodiments, the cells are natural killer (NK) cells. In some embodiments, the cells are monocytes or granulocytes, e.g., myeloid cells, macrophages, neutrophils, dendritic cells, mast cells, eosinophils, and/or basophils.

In some embodiments, the cells include one or more polynucleotides introduced via genetic engineering, and thereby express recombinant or genetically engineered products of such polynucleotides. In some embodiments, the polynucleotides are heterologous, i.e., normally not present in a cell or sample obtained from the cell, such as one obtained from another organism or cell, which for example, is not ordinarily found in the cell being engineered and/or an organism from which such cell is derived. In some embodiments, the polynucleotides are not naturally occurring, such as a polynucleotide not found in nature, including one comprising chimeric combinations of polynucleotides encoding various domains from multiple different cell types. In some embodiments, the cells (e.g., engineered cells) comprise a vector (e.g., a viral vector, expression vector, etc.) as described herein such as a vector comprising a nucleic acid encoding a recombinant receptor described herein.

A. Vectors and Methods for Genetic Engineering

Also provided are methods, polynucleotides, compositions, and kits, for expressing the binding molecules (e.g., anti-BCMA binding molecules), including recombinant receptors (e.g., CARs) comprising the binding molecules, and for producing the genetically engineered cells expressing such binding molecules. In some embodiments, one or more binding molecules, including recombinant receptors (e.g., CARs) can be genetically engineered into cells or plurality of cells. The genetic engineering generally involves introduction of a nucleic acid encoding the recombinant or engineered component into the cell, such as by retroviral transduction, transfection, or transformation.

Also provided are polynucleotides encoding the chimeric antigen receptors and/or portions, e.g., chains, thereof. Among the provided polynucleotides are those encoding the anti-BCMA chimeric antigen receptors (e.g., antigen-binding fragment) described herein. Also provided are polynucleotides encoding one or more antibodies and/or portions thereof, e.g., those encoding one or more of the anti-BCMA antibodies (e.g., antigen-binding fragment) described herein and/or other antibodies and/or portions thereof, e.g., antibodies and/or portions thereof that binds other target antigens. The polynucleotides may include those encompassing natural and/or non-naturally occurring nucleotides and bases, e.g., including those with backbone modifications. The terms "nucleic acid molecule", "nucleic acid" and "polynucleotide" may be used interchangeably, and refer to a polymer of nucleotides. Such polymers of nucleotides may contain natural and/or non-natural nucleotides, and include, but are not limited to, DNA, RNA, and PNA. "Nucleic acid sequence" refers to the linear sequence of nucleotides that comprise the nucleic acid molecule or polynucleotide.

Also provided are polynucleotides that have been optimized for codon usage and/or to eliminate splice sites, such as cryptic splice sites. Also provided are methods of optimizing and producing the coding sequences of chimeric antigen receptors, such as any of the chimeric antigen receptors described herein. Such methods are described in Section II herein.

Also provided are vectors containing the polynucleotides, such as any of the polynucleotides described herein, and host cells containing the vectors, e.g., for producing the antibodies or antigen-binding fragments thereof. In some embodiments, the vector is a viral vector. In some embodiments, the vector is a retroviral vector, or a lentiviral vector. Also provided are methods for producing the antibodies or antigen-binding fragments thereof. The nucleic acid may encode an amino acid sequence comprising the $V_L$ region and/or an amino acid sequence comprising the $V_H$ region of the antibody (e.g., the light and/or heavy chains of the antibody). The nucleic acid may encode one or more amino acid sequence comprising the $V_L$ region and/or an amino acid sequence comprising the $V_H$ region of the antibody (e.g., the light and/or heavy chains of the antibody). In a further embodiment, one or more vectors (e.g., expression vectors) comprising such polynucleotides are provided. In a further embodiment, a host cell comprising such polynucleotides is provided. In one such embodiment, a host cell comprises (e.g., has been transformed with) a vector comprising a nucleic acid that encodes an amino acid sequence comprising the $V_H$ region of the antibody. In another such embodiment, a host cell comprises (e.g., has been transformed with) (1) a vector comprising a nucleic acid that encodes an amino acid sequence comprising the $V_L$ region of the antibody and an amino acid sequence comprising the $V_H$ region of the antibody, or (2) a first vector comprising a nucleic acid that encodes an amino acid sequence comprising the $V_L$ region of the antibody and a second vector comprising a nucleic acid that encodes an amino acid sequence comprising the $V_H$ region of the antibody. In some embodiments, a host cell comprises (e.g., has been transformed with) one or more vectors comprising one or more nucleic acid that encodes one or more an amino acid sequence comprising one or more antibodies and/or portions thereof, e.g., antigen-binding fragments thereof. In some embodiments, one or more such host cells are provided. In some embodiments, a composition containing one or more such host cells are provided. In some embodiments, the one or more host cells can express different antibodies, or the same antibody. In some embodiments, each of the host cells can express more than one antibody.

Also provided are methods of making the anti-BCMA chimeric antigen receptors. For recombinant production of the chimeric receptors, a nucleic acid sequence encoding a chimeric receptor antibody, e.g., as described herein, may be isolated and inserted into one or more vectors for further cloning and/or expression in a host cell. Such nucleic acid sequences may be readily isolated and sequenced using conventional procedures (e.g., by using oligonucleotide probes that are capable of binding specifically to genes encoding the heavy and light chains of the antibody). In some embodiments, a method of making the anti-BCMA chimeric antigen receptor is provided, wherein the method comprises culturing a host cell comprising a nucleic acid sequence encoding the antibody, as provided above, under conditions suitable for expression of the receptor.

In some aspects, for production of isolated or secreted polypeptides, in addition to prokaryotes, eukaryotic microbes such as filamentous fungi or yeast are suitable cloning or expression hosts for antibody-encoding vectors, including fungi and yeast strains whose glycosylation pathways have been modified to mimic or approximate those in human cells, resulting in the production of an antibody with a partially or fully human glycosylation pattern. See Gerngross, Nat. Biotech. 22:1409-1414 (2004), and Li et al., Nat. Biotech. 24:210-215 (2006).

Exemplary eukaryotic cells that may be used to express polypeptides, including isolated or secreted polypeptides, include, but are not limited to, COS cells, including COS 7 cells; 293 cells, including 293-6E cells; CHO cells, including CHO-S, DG44. Lec13 CHO cells, and FUT8 CHO cells; PER.C6® cells; and NSO cells. In some embodiments, the antibody heavy chains and/or light chains (e.g., $V_H$ region and/or $V_L$ region) may be expressed in yeast. See, e.g., U.S. Publication No. US 2006/0270045 A1. In some embodiments, a particular eukaryotic host cell is selected based on its ability to make desired post-translational modifications to the heavy chains and/or light chains (e.g., $V_H$ region and/or $V_L$ region). For example, in some embodiments, CHO cells produce polypeptides that have a higher level of sialylation than the same polypeptide produced in 293 cells.

In particular examples immune cells, such as human immune cells are used to express the provided polypeptides encoding chimeric antigen receptors. In some examples, the immune cells are T cells, such as CD4+ and/or CD8+ immune cells, including primary cells, such as primary CD4+ and CD8+ cells.

In some embodiments, gene transfer is accomplished by first stimulating the cell, such as by combining it with a stimulus that induces a response such as proliferation, survival, and/or activation, e.g., as measured by expression of a cytokine or activation marker, followed by transduction of the activated cells, and expansion in culture to numbers sufficient for clinical applications.

In some contexts, overexpression of a stimulatory factor (for example, a lymphokine or a cytokine) may be toxic to a subject. Thus, in some contexts, the engineered cells include gene segments that cause the cells to be susceptible to negative selection in vivo, such as following administration in adoptive immunotherapy. For example in some aspects, the cells are engineered so that they can be eliminated as a result of a change in the in vivo condition of the patient to which they are administered. The negative select-able phenotype may result from the insertion of a gene that confers sensitivity to an administered agent, for example, a compound. Negative selectable genes include the Herpes simplex virus type I thymidine kinase (HSV-I TK) gene (Wigler et al., Cell 2:223, 1977) which confers ganciclovir sensitivity; the cellular hypoxanthine phosphoribosyltransferase (HPRT) gene, the cellular adenine phosphoribosyltransferase (APRT) gene, bacterial cytosine deaminase, (Mullen et al., Proc. Natl. Acad. Sci. USA. 89:33 (1992)).

In some aspects, the cells further are engineered to promote expression of cytokines or other factors. Various methods for the introduction of genetically engineered components, e.g., antigen receptors, e.g., CARs, are well known and may be used with the provided methods and compositions. Exemplary methods include those for transfer of polynucleotides encoding the receptors, including via viral, e.g., retroviral or lentiviral, transduction, transposons, and electroporation.

In some embodiments, recombinant polynucleotides are transferred into cells using recombinant infectious virus particles, such as, e.g., vectors derived from simian virus 40 (SV40), adenoviruses, adeno-associated virus (AAV). In some embodiments, recombinant polynucleotides are transferred into T cells using recombinant lentiviral vectors or retroviral vectors, such as gamma-retroviral vectors (see, e.g., Koste et al. (2014) Gene Therapy 2014 Apr. 3. doi: 10.1038/gt.2014.25; Carlens et al. (2000) Exp Hematol 28(10): 1137-46; Alonso-Camino et al. (2013) Mol Ther Nucl Acids 2, e93; Park et al., Trends Biotechnol. 2011 Nov. 29(11): 550-557).

In some embodiments, the retroviral vector has a long terminal repeat sequence (LTR), e.g., a retroviral vector derived from the Moloney murine leukemia virus (MoMLV), myeloproliferative sarcoma virus (MPSV), murine embryonic stem cell virus (MESV), murine stem cell virus (MSCV), spleen focus forming virus (SFFV), or human immunodeficiency virus type 1 (HIV-1). Most retroviral vectors are derived from murine retroviruses. In some embodiments, the retroviruses include those derived from any avian or mammalian cell source. The retroviruses typically are amphotropic, meaning that they are capable of infecting host cells of several species, including humans. In one embodiment, the gene to be expressed replaces the retroviral gag, pol and/or env sequences. A number of illustrative retroviral systems have been described (e.g., U.S. Pat. Nos. 5,219,740; 6,207,453; 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109.

Methods of lentiviral transduction are known. Exemplary methods are described in, e.g., Wang et al. (2012) J. Immunother. 35(9): 689-701; Cooper et al. (2003) Blood. 101: 1637-1644; Verhoeyen et al. (2009) Methods Mol Biol. 506: 97-114; and Cavalieri et al. (2003) Blood. 102(2): 497-505.

In some embodiments, recombinant polynucleotides are transferred into T cells via electroporation (see, e.g., Chicaybam et al, (2013) PLoS ONE 8(3): e60298 and Van Tedeloo et al. (2000) Gene Therapy 7(16): 1431-1437). In some embodiments, recombinant polynucleotides are transferred into T cells via transposition (see, e.g., Manuri et al. (2010) Hum Gene Ther 21(4): 427-437; Sharma et al. (2013) Molec Ther Nucl Acids 2, e74; and Huang et al. (2009) Methods Mol Biol 506: 115-126). Other methods of introducing and expressing genetic material in immune cells include calcium phosphate transfection (e.g., as described in Current Protocols in Molecular Biology, John Wiley & Sons, New York. N.Y.), protoplast fusion, cationic liposome-mediated transfection; tungsten particle-facilitated microparticle bombardment (Johnston, Nature, 346: 776-777 (1990)); and strontium phosphate DNA co-precipitation (Brash et al., Mol. Cell Biol., 7: 2031-2034 (1987)).

Other approaches and vectors for transfer of the polynucleotides encoding the recombinant products are those described, e.g., in international patent application, Publication No.: WO2014055668, and U.S. Pat. No. 7,446,190.

Among additional polynucleotides, e.g., genes for introduction are those to improve the efficacy of therapy, such as by promoting viability and/or function of transferred cells; genes to provide a genetic marker for selection and/or evaluation of the cells, such as to assess in vivo survival or localization; genes to improve safety, for example, by making the cell susceptible to negative selection in vivo as described by Lupton S. D. et al., Mol. and Cell Biol., 11:6 (1991); and Riddell et al., Human Gene Therapy 3:319-338 (1992); see also the publications of PCT/US91/08442 and PCT/US94/05601 by Lupton et al. describing the use of bifunctional selectable fusion genes derived from fusing a dominant positive selectable marker with a negative selectable marker. See, e.g., Riddell et al., U.S. Pat. No. 6,040,177, at columns 14-17.

In some embodiments, one or more binding molecules, including antibodies and/or recombinant receptors (e.g., CARs), can be genetically engineered to be expressed in cells or plurality of cells. In some embodiments, a first recombinant receptor and a second binding molecule, e.g., recombinant receptor, are encoded by the same or separate nucleic acid molecules. In some embodiments, additional binding molecules are engineered to be expressed in cells or a plurality of cells.

In some cases, the polynucleotide containing nucleic acid sequences encoding the BCMA-binding receptor, e.g., chimeric antigen receptor (CAR), contains a signal sequence that encodes a signal peptide. In some aspects, the signal sequence may encode a signal peptide derived from a native polypeptide. In other aspects, the signal sequence may encode a heterologous or non-native signal peptide. In some aspects, non-limiting exemplary signal peptide include a signal peptide of the IgG kappa chain set forth in SEQ ID NO: 620, or encoded by the nucleotide sequence set forth in SEQ ID NO: 619 or 682-685; a GMCSFR alpha chain set forth in SEQ ID NO:851 and encoded by the nucleotide sequence set forth in SEQ ID NO:850; a CD8 alpha signal peptide set forth in SEQ ID NO:852; or a CD33 signal peptide set forth in SEQ ID NO:853.

In some embodiments the vector or construct can contain promoter and/or enhancer or regulatory elements to regulate expression of the encoded recombinant receptor. In some examples the promoter and/or enhancer or regulatory elements can be condition-dependent promoters, enhancers, and/or regulatory elements. In some examples these elements drive expression of the transgene. In some examples, the CAR transgene can be operatively linked to a promoter, such as an EF1alpha promoter with an HTLV1 enhancer (SEQ ID NO: 635). In some examples, the CAR transgene is operatively linked to a Woodchuck Hepatitis Virus (WHP) Posttranscriptional Regulatory Element (WPRE; SEQ ID NO: 636), located downstream of the transgene.

In some embodiments, the vector or construct can contain a single promoter that drives the expression of one or more nucleic acid molecules. In some embodiments, such nucleic acid molecules, e.g., transcripts, can be multicistronic (bicistronic or tricistronic, see e.g., U.S. Pat. No. 6,060,273). For example, in some embodiments, transcription units can be engineered as a bicistronic unit containing an IRES (internal ribosome entry site), which allows coexpression of gene products (e.g. encoding a first and second chimeric receptor) by a message from a single promoter. Alternatively, in some cases, a single promoter may direct expression of an RNA that contains, in a single open reading frame (ORF), two or three genes (e.g. encoding a first and second binding molecules, e.g., antibody recombinant receptor) separated from one another by sequences encoding a self-cleavage peptide (e.g., 2A cleavage sequences) or a protease recognition site (e.g., furin). The ORF thus encodes a single polypeptide, which, either during (in the case of T2A) or after translation, is cleaved into the individual proteins. In some cases, the peptide, such as T2A, can cause the ribosome to skip (ribosome skipping) synthesis of a peptide bond at the C-terminus of a 2A element, leading to separation between the end of the 2A sequence and the next peptide downstream (see, for example, de Felipe. *Genetic Vaccines and Ther.* 2:13 (2004) and deFelipe et al. *Traffic* 5:616-626 (2004)). Many 2A elements are known. Examples of 2A sequences that can be used in the methods and polynucleotides disclosed herein, without limitation, 2A sequences from the foot-and-mouth disease virus (F2A, e.g., SEQ ID NO: 659 or 660), equine rhinitis A virus (E2A, e.g., SEQ ID NO: 657 or 658), Thosea asigna virus (T2A, e.g., SEQ ID NO: 631, 653, or 654), and porcine teschovirus-1 (P2A, e.g., SEQ ID NO: 655 or 656) as described in U.S. Patent Publication No. 20070116690. In some embodiments, the one or more different or separate promoters drive the expression of one or more nucleic acid molecules encoding the one or more binding molecules, e.g., recombinant receptors.

Any of the binding molecules, e.g., antibodies and/or recombinant receptors provided herein, e.g., BCMA-binding molecules and/or the additional recombinant receptors, can be encoded by polynucleotides containing one or more nucleic acid molecules encoding the receptors, in any combinations or arrangements. For example, one, two, three or more polynucleotides can encode one, two, three or more different receptors or domains. In some embodiments, one vector or construct contains nucleic acid molecules encoding one or more binding molecules, e.g., antibody and/or recombinant receptor, and a separate vector or construct contains nucleic acid molecules encoding an additional binding molecule, e.g., antibody and/or recombinant receptor. Each of the nucleic acid molecules can also encode one or more marker(s), such as a surface marker, e.g., truncated EGFR (tEGFR).

Also provided are compositions containing one or more of the nucleic acid molecules, vectors or constructs, such as any described above. In some embodiments, the nucleic acid molecules, vectors, constructs or compositions can be used to engineer cells, such as T cells, to express any of the binding molecules, e.g., antibody or recombinant receptor, and/or the additional binding molecules.

B. Preparation of Cells for Engineering

In some embodiments, preparation of the engineered cells includes one or more culture and/or preparation steps. The cells for introduction of the recombinant receptor (e.g., CAR) may be isolated from a sample, such as a biological sample, e.g., one obtained from or derived from a subject. In some embodiments, the subject from which the cell is isolated is one having the disease or condition or in need of a cell therapy or to which cell therapy will be administered. The subject in some embodiments is a human in need of a particular therapeutic intervention, such as the adoptive cell therapy for which cells are being isolated, processed, and/or engineered.

Accordingly, the cells in some embodiments are primary cells, e.g., primary human cells. The samples include tissue, fluid, and other samples taken directly from the subject, as well as samples resulting from one or more processing steps, such as separation, centrifugation, genetic engineering (e.g. transduction with viral vector), washing, and/or incubation. The biological sample can be a sample obtained directly from a biological source or a sample that is processed. Biological samples include, but are not limited to, body fluids, such as blood, plasma, serum, cerebrospinal fluid, synovial fluid, urine and sweat, tissue and organ samples, including processed samples derived therefrom.

In some aspects, the sample from which the cells are derived or isolated is blood or a blood-derived sample, or is or is derived from an apheresis or leukapheresis product. Exemplary samples include whole blood, peripheral blood mononuclear cells (PBMCs), leukocytes, bone marrow, thymus, tissue biopsy, tumor, leukemia, lymphoma, lymph node, gut associated lymphoid tissue, mucosa associated lymphoid tissue, spleen, other lymphoid tissues, liver, lung, stomach, intestine, colon, kidney, pancreas, breast, bone, prostate, cervix, testes, ovaries, tonsil, or other organ, and/or cells derived therefrom. Samples include, in the context of cell therapy, e.g., adoptive cell therapy, samples from autologous and allogeneic sources.

In some embodiments, the cells are derived from cell lines, e.g., T cell lines. The cells in some embodiments are obtained from a xenogeneic source, for example, from mouse, rat, non-human primate, or pig.

In some embodiments, isolation of the cells includes one or more preparation and/or non-affinity based cell separation steps. In some examples, cells are washed, centrifuged, and/or incubated in the presence of one or more reagents, for example, to remove unwanted components, enrich for desired components, lyse or remove cells sensitive to particular reagents. In some examples, cells are separated based on one or more property, such as density, adherent properties, size, sensitivity and/or resistance to particular components.

In some examples, cells from the circulating blood of a subject are obtained, e.g., by apheresis or leukapheresis. The samples, in some aspects, contain lymphocytes, including T cells, monocytes, granulocytes, B cells, other nucleated white blood cells, red blood cells, and/or platelets, and in some aspects contain cells other than red blood cells and platelets.

In some embodiments, the blood cells collected from the subject are washed, e.g., to remove the plasma fraction and to place the cells in an appropriate buffer or media for subsequent processing steps. In some embodiments, the cells are washed with phosphate buffered saline (PBS). In some embodiments, the wash solution lacks calcium and/or magnesium and/or many or all divalent cations. In some aspects, a washing step is accomplished a semi-automated "flow-through" centrifuge (for example, the Cobe 2991 cell processor, Baxter) according to the manufacturer's instructions. In some aspects, a washing step is accomplished by tangential flow filtration (TFF) according to the manufacturer's instructions. In some embodiments, the cells are resuspended in a variety of biocompatible buffers after washing, such as, for example, $Ca^{++}/Mg^{++}$ free PBS. In certain embodiments, components of a blood cell sample are removed and the cells directly resuspended in culture media.

In some embodiments, the methods include density-based cell separation methods, such as the preparation of white blood cells from peripheral blood by lysing the red blood cells and centrifugation through a Percoll or Ficoll gradient.

In some embodiments, the isolation methods include the separation of different cell types based on the expression or presence in the cell of one or more specific molecules, such as surface markers, e.g., surface proteins, intracellular markers, or nucleic acid. In some embodiments, any known method for separation based on such markers may be used. In some embodiments, the separation is affinity- or immunoaffinity-based separation. For example, the isolation in some aspects includes separation of cells and cell populations based on the cells' expression or expression level of one or more markers, typically cell surface markers, for example, by incubation with an antibody or binding partner that specifically binds to such markers, followed generally by washing steps and separation of cells having bound the antibody or binding partner, from those cells having not bound to the antibody or binding partner.

Such separation steps can be based on positive selection, in which the cells having bound the reagents are retained for further use, and/or negative selection, in which the cells having not bound to the antibody or binding partner are retained. In some examples, both fractions are retained for further use. In some aspects, negative selection can be particularly useful where no antibody is available that specifically identifies a cell type in a heterogeneous population, such that separation is best carried out based on markers expressed by cells other than the desired population.

The separation need not result in 100% enrichment or removal of a particular cell population or cells expressing a particular marker. For example, positive selection of or enrichment for cells of a particular type, such as those expressing a marker, refers to increasing the number or percentage of such cells, but need not result in a complete absence of cells not expressing the marker. Likewise, negative selection, removal, or depletion of cells of a particular type, such as those expressing a marker, refers to decreasing the number or percentage of such cells, but need not result in a complete removal of all such cells.

In some examples, multiple rounds of separation steps are carried out, where the positively or negatively selected fraction from one step is subjected to another separation step, such as a subsequent positive or negative selection. In some examples, a single separation step can deplete cells expressing multiple markers simultaneously, such as by incubating cells with a plurality of antibodies or binding partners, each specific for a marker targeted for negative selection. Likewise, multiple cell types can simultaneously be positively selected by incubating cells with a plurality of antibodies or binding partners expressed on the various cell types.

For example, in some aspects, specific subpopulations of T cells, such as cells positive or expressing high levels of one or more surface markers, e.g., CD28+, CD62L+, CCR7+, CD27+, CD127+, CD4+, CD8+, CD45RA+, and/or CD45RO+ T cells, are isolated by positive or negative selection techniques.

For example, CD3+, CD28+ T cells can be positively selected using CD3/CD28 conjugated magnetic beads (e.g., DYNABEADS® M-450 CD3/CD28 T Cell Expander, MACSiBeads™, etc.).

In some embodiments, isolation is carried out by enrichment for a particular cell population by positive selection, or depletion of a particular cell population, by negative selection. In some embodiments, positive or negative selection is accomplished by incubating cells with one or more antibodies or other binding agent that specifically bind to one or more surface markers expressed or expressed (marker$^+$) at a relatively higher level (marker$^{high}$) on the positively or negatively selected cells, respectively.

In some embodiments, T cells are separated from a PBMC sample by negative selection of markers expressed on non-T cells, such as B cells, monocytes, or other white blood cells, such as CD14. In some aspects, CD4+ and/or CD8+ selection steps are used to separate CD4+ helper and CD8+ cytotoxic T cells from a composition, such as from a PBMC composition such as one obtained via leukapheresis. Such CD4+ and CD8+ populations, in some aspects, can be further sorted into sub-populations by positive or negative selection for markers expressed or expressed to a relatively higher degree on one or more naive, memory, and/or effector T cell subpopulations. In some embodiments, CD4+ and CD8+ cells are mixed at a desired ratio In some embodiments, CD8+ cells are further enriched for or depleted of naive, central memory, effector memory, and/or central memory stem cells, such as by positive or negative selection based on surface antigens associated with the respective subpopulation. In some embodiments, enrichment for central memory T ($T_{CM}$) cells is carried out to increase efficacy, such as to improve long-term survival, expansion, and/or engraftment following administration, which in some aspects is particularly robust in such sub-populations. See Terakura et al. (2012) Blood. 1:72-82; Wang et al. (2012) J Immunother. 35(9):689-701. In some embodiments, combining $T_{CM}$-enriched CD8+ T cells and CD4+ T cells further enhances efficacy.

In embodiments, memory T cells are present in both CD62L+ and CD62L- subsets of CD8+ peripheral blood lymphocytes. PBMC can be enriched for or depleted of CD62L-CD8+ and/or CD62L+CD8+ fractions, such as using anti-CD8 and anti-CD62L antibodies.

In some embodiments, the enrichment for central memory T ($T_{CM}$) cells is based on positive or high surface expression of CD45RO, CD62L, CCR7, CD28, CD3, and/or CD 127; in some aspects, it is based on negative selection for cells expressing or highly expressing CD45RA and/or granzyme B. In some aspects, isolation of a CD8+ population enriched for $T_{CM}$ cells is carried out by depletion of cells expressing CD4, CD14, CD45RA, and positive selection or enrichment for cells expressing CD62L. In one aspect, enrichment for central memory T ($T_{CM}$) cells is carried out starting with a negative fraction of cells selected based on CD4 expression, which is subjected to a negative selection based on expression of CD14 and CD45RA, and a positive selection based on CD62L. Such selections in some aspects are carried out simultaneously and in other aspects are carried out sequentially, in either order. In some aspects, the same CD4 expression-based selection step used in preparing the CD8+ cell population or subpopulation, also is used to generate the CD4+ cell population or sub-population, such that both the positive and negative fractions from the CD4-based separation are retained and used in subsequent steps of the methods, optionally following one or more further positive or negative selection steps.

In a particular example, a sample of PBMCs or other white blood cell sample is subjected to selection of CD4+ cells, where both the negative and positive fractions are retained. The negative fraction then is subjected to negative selection based on expression of CD14 and CD45RA, and positive selection based on a marker characteristic of central memory T cells, such as CD62L or CCR7, where the positive and negative selections are carried out in either order.

CD4+ T helper cells are sorted into naïve, central memory, and effector cells by identifying cell populations that have cell surface antigens. CD4+ lymphocytes can be obtained by standard methods. In some embodiments, naive CD4+ T lymphocytes are CD45RO-, CD45RA+, CD62L+, CD4+ T cells. In some embodiments, central memory CD4+ cells are CD62L+ and CD45RO+. In some embodiments, effector CD4+ cells are CD62L- and CD45RO-.

In one example, to enrich for CD4+ cells by negative selection, a monoclonal antibody cocktail typically includes antibodies to CD14, CD20, CD11b, CD16, HLA-DR, and CD8. In some embodiments, the antibody or binding partner is bound to a solid support or matrix, such as a magnetic bead or paramagnetic bead, to allow for separation of cells for positive and/or negative selection. For example, in some embodiments, the cells and cell populations are separated or isolated using immunomagnetic (or affinitymagnetic) separation techniques (reviewed in Methods in Molecular Medicine, vol. 58: Metastasis Research Protocols, Vol. 2: Cell Behavior In vitro and In vivo, p 17-25 Edited by: S. A. Brooks and U. Schumacher® Humana Press Inc., Totowa, N.J.).

In some aspects, the sample or composition of cells to be separated is incubated with small, magnetizable or magnetically responsive material, such as magnetically responsive particles or microparticles, such as paramagnetic beads (e.g., such as Dynabeads® or MACS® beads). The magnetically responsive material, e.g., particle, generally is directly or indirectly attached to a binding partner, e.g., an antibody, that specifically binds to a molecule, e.g., surface marker, present on the cell, cells, or population of cells that it is desired to separate, e.g., that it is desired to negatively or positively select.

In some embodiments, the magnetic particle or bead comprises a magnetically responsive material bound to a specific binding member, such as an antibody or other binding partner. There are many well-known magnetically responsive materials used in magnetic separation methods. Suitable magnetic particles include those described in Molday, U.S. Pat. No. 4,452,773, and in European Patent Specification EP 452342 B, which are hereby incorporated by reference. Colloidal sized particles, such as those described in Owen U.S. Pat. No. 4,795,698, and Liberti et al., U.S. Pat. No. 5,200,084, are other examples.

The incubation generally is carried out under conditions whereby the antibodies or binding partners, or molecules, such as secondary antibodies or other reagents, which specifically bind to such antibodies or binding partners, which are attached to the magnetic particle or bead, specifically bind to cell surface molecules if present on cells within the sample.

In some aspects, the sample is placed in a magnetic field, and those cells having magnetically responsive or magnetizable particles attached thereto will be attracted to the magnet and separated from the unlabeled cells. For positive selection, cells that are attracted to the magnet are retained; for negative selection, cells that are not attracted (unlabeled cells) are retained. In some aspects, a combination of positive and negative selection is performed during the same selection step, where the positive and negative fractions are retained and further processed or subject to further separation steps.

In certain embodiments, the magnetically responsive particles are coated in primary antibodies or other binding partners, secondary antibodies, lectins, enzymes, or streptavidin. In certain embodiments, the magnetic particles are attached to cells via a coating of primary antibodies specific for one or more markers. In certain embodiments, the cells, rather than the beads, are labeled with a primary antibody or binding partner, and then cell-type specific secondary antibody- or other binding partner (e.g., streptavidin)-coated magnetic particles, are added. In certain embodiments, streptavidin-coated magnetic particles are used in conjunction with biotinylated primary or secondary antibodies.

In some embodiments, the magnetically responsive particles are left attached to the cells that are to be subsequently incubated, cultured and/or engineered; in some aspects, the particles are left attached to the cells for administration to a patient. In some embodiments, the magnetizable or magnetically responsive particles are removed from the cells. Methods for removing magnetizable particles from cells are known and include, e.g., the use of competing non-labeled antibodies, magnetizable particles or antibodies conjugated to cleavable linkers, etc. In some embodiments, the magnetizable particles are biodegradable.

In some embodiments, the affinity-based selection is via magnetic-activated cell sorting (MACS®) (Miltenyi Biotec, Auburn, Calif.). Magnetic Activated Cell Sorting (MACS®) systems are capable of high-purity selection of cells having magnetized particles attached thereto. In certain embodiments, MACS® operates in a mode wherein the non-target and target species are sequentially eluted after the application of the external magnetic field. That is, the cells attached to magnetized particles are held in place while the unattached species are eluted. Then, after this first elution step is completed, the species that were trapped in the magnetic field and were prevented from being eluted are freed in some manner such that they can be eluted and recovered. In certain embodiments, the non-target cells are labelled and depleted from the heterogeneous population of cells.

In certain embodiments, the isolation or separation is carried out using a system, device, or apparatus that carries out one or more of the isolation, cell preparation, separation, processing, incubation, culture, and/or formulation steps of the methods. In some aspects, the system is used to carry out each of these steps in a closed or sterile environment, for example, to minimize error, user handling and/or contamination. In one example, the system is a system as described in International Patent Application, Publication Number WO2009/072003, or US 20110003380 A1.

In some embodiments, the system or apparatus carries out one or more, e.g., all, of the isolation, processing, engineering, and formulation steps in an integrated or self-contained system, and/or in an automated or programmable fashion. In some aspects, the system or apparatus includes a computer and/or computer program in communication with the system or apparatus, which allows a user to program, control, assess the outcome of, and/or adjust various aspects of the processing, isolation, engineering, and formulation steps.

In some aspects, the separation and/or other steps is carried out using CliniMACS® system (Miltenyi Biotec), for example, for automated separation of cells on a clinical-scale level in a closed and sterile system. Components can include an integrated microcomputer, magnetic separation unit, peristaltic pump, and various pinch valves. The integrated computer in some aspects controls all components of the instrument and directs the system to perform repeated procedures in a standardized sequence. The magnetic separation unit in some aspects includes a movable permanent magnet and a holder for the selection column. The peristaltic pump controls the flow rate throughout the tubing set and, together with the pinch valves, ensures the controlled flow of buffer through the system and continual suspension of cells.

The CliniMACS® system in some aspects uses antibody-coupled magnetizable particles that are supplied in a sterile, non-pyrogenic solution. In some embodiments, after labelling of cells with magnetic particles the cells are washed to remove excess particles. A cell preparation bag is then connected to the tubing set, which in turn is connected to a bag containing buffer and a cell collection bag. The tubing set consists of pre-assembled sterile tubing, including a pre-column and a separation column, and are for single use only. After initiation of the separation program, the system automatically applies the cell sample onto the separation column. Labelled cells are retained within the column, while unlabeled cells are removed by a series of washing steps. In some embodiments, the cell populations for use with the methods described herein are unlabeled and are not retained in the column. In some embodiments, the cell populations for use with the methods described herein are labeled and are retained in the column. In some embodiments, the cell populations for use with the methods described herein are eluted from the column after removal of the magnetic field, and are collected within the cell collection bag.

In certain embodiments, separation and/or other steps are carried out using the CliniMACS Prodigy® system (Miltenyi Biotec). The CliniMACS Prodigy® system in some aspects is equipped with a cell processing unity that permits automated washing and fractionation of cells by centrifugation. The CliniMACS Prodigy® system can also include an onboard camera and image recognition software that determines the optimal cell fractionation endpoint by discerning the macroscopic layers of the source cell product. For example, peripheral blood may be automatically separated into erythrocytes, white blood cells and plasma layers. The CliniMACS Prodigy® system can also include an integrated cell cultivation chamber which accomplishes cell culture protocols such as, e.g., cell differentiation and expansion, antigen loading, and long-term cell culture. Input ports can allow for the sterile removal and replenishment of media and cells can be monitored using an integrated microscope. See, e.g., Klebanoff et al. (2012) J Immunother. 35(9): 651-660, Terakura et al. (2012) Blood. 1:72-82, and Wang et al. (2012) J Immunother. 35(9):689-701.

In some embodiments, a cell population described herein is collected and enriched (or depleted) via flow cytometry, in which cells stained for multiple cell surface markers are carried in a fluidic stream. In some embodiments, a cell population described herein is collected and enriched (or depleted) via preparative scale (FACS)-sorting. In certain embodiments, a cell population described herein is collected and enriched (or depleted) by use of microelectromechanical systems (MEMS) chips in combination with a FACS-based detection system (see, e.g., WO 2010/033140, Cho et al. (2010) Lab Chip 10, 1567-1573; and Godin et al. (2008) J Biophoton. 1(5):355-376. In both cases, cells can be labeled with multiple markers, allowing for the isolation of well-defined T cell subsets at high purity.

In some embodiments, the antibodies or binding partners are labeled with one or more detectable marker, to facilitate separation for positive and/or negative selection. For example, separation may be based on binding to fluorescently labeled antibodies. In some examples, separation of cells based on binding of antibodies or other binding partners specific for one or more cell surface markers are carried in a fluidic stream, such as by fluorescence-activated cell sorting (FACS), including preparative scale (FACS) and/or microelectromechanical systems (MEMS) chips, e.g., in combination with a flow-cytometric detection system. Such methods allow for positive and negative selection based on multiple markers simultaneously.

In some embodiments, the preparation methods include steps for freezing, e.g., cryopreserving, the cells, either before or after isolation, incubation, and/or engineering. In some embodiments, the freeze and subsequent thaw step removes granulocytes and, to some extent, monocytes in the cell population. In some embodiments, the cells are suspended in a freezing solution, e.g., following a washing step to remove plasma and platelets. Any of a variety of known freezing solutions and parameters in some aspects may be used. One example involves using PBS containing 20% DMSO and 8% human serum albumin (HSA), or other suitable cell freezing media. This is then diluted 1:1 with media so that the final concentration of DMSO and HSA are 10% and 4%, respectively. The cells are then frozen to −80° C. at a rate of 1° per minute and stored in the vapor phase of a liquid nitrogen storage tank.

In some embodiments, the provided methods include cultivation, incubation, culture, and/or genetic engineering steps. For example, in some embodiments, provided are methods for incubating and/or engineering the depleted cell populations and culture-initiating compositions.

Thus, in some embodiments, the cell populations are incubated in a culture-initiating composition. The incubation and/or engineering may be carried out in a culture vessel, such as a unit, chamber, well, column, tube, tubing set, valve, vial, culture dish, bag, or other container for culture or cultivating cells.

In some embodiments, the cells are incubated and/or cultured prior to or in connection with genetic engineering. The incubation steps can include culture, cultivation, stimulation, activation, and/or propagation. In some embodiments, the compositions or cells are incubated in the presence of stimulating conditions or a stimulatory agent. Such conditions include those designed to induce proliferation, expansion, activation, and/or survival of cells in the population, to mimic antigen exposure, and/or to prime the cells for genetic engineering, such as for the introduction of a recombinant antigen receptor.

The conditions can include one or more of particular media, temperature, oxygen content, carbon dioxide content, time, agents, e.g., nutrients, amino acids, antibiotics, ions, and/or stimulatory factors, such as cytokines, chemokines, antigens, binding partners, fusion proteins, recombinant soluble receptors, and any other agents designed to activate the cells.

In some embodiments, the stimulating conditions or agents include one or more agent, e.g., ligand, which is capable of stimulating or activating an intracellular signaling domain of a TCR complex. In some aspects, the agent turns on or initiates TCR/CD3 intracellular signaling cascade in a T cell. Such agents can include antibodies, such as those specific for a TCR, e.g. anti-CD3. In some embodiments, the stimulating conditions include one or more agent, e.g. ligand, which is capable of stimulating a costimulatory receptor, e.g., anti-CD28. In some embodiments, such agents and/or ligands may be, bound to solid support such as a bead, and/or one or more cytokines. Optionally, the expansion method may further comprise the step of adding anti-CD3 and/or anti CD28 antibody to the culture medium (e.g., at a concentration of at least about 0.5 ng/ml). In some embodiments, the stimulating agents include IL-2, IL-15 and/or IL-7. In some aspects, the IL-2 concentration is at least about 10 units/mL.

In some aspects, incubation is carried out in accordance with techniques such as those described in U.S. Pat. No. 6,040,177 to Riddell et al., Klebanoff et al. (2012) J Immunother. 35(9): 651-660, Terakura et al. (2012) Blood. 1:72-82, and/or Wang et al. (2012) J Immunother. 35(9):689-701.

In some embodiments, the T cells are expanded by adding to the culture-initiating composition feeder cells, such as non-dividing peripheral blood mononuclear cells (PBMC), (e.g., such that the resulting population of cells contains at least about 5, 10, 20, or 40 or more PBMC feeder cells for each T lymphocyte in the initial population to be expanded); and incubating the culture (e.g. for a time sufficient to expand the numbers of T cells). In some aspects, the non-dividing feeder cells can comprise gamma-irradiated PBMC feeder cells. In some embodiments, the PBMC are irradiated with gamma rays in the range of about 3000 to 3600 rads to prevent cell division. In some aspects, the feeder cells are added to culture medium prior to the addition of the populations of T cells.

In some embodiments, the stimulating conditions include temperature suitable for the growth of human T lymphocytes, for example, at least about 25 degrees Celsius, generally at least about 30 degrees, and generally at or about 37 degrees Celsius. Optionally, the incubation may further comprise adding non-dividing EBV-transformed lymphoblastoid cells (LCL) as feeder cells. LCL can be irradiated with gamma rays in the range of about 6000 to 10,000 rads. The LCL feeder cells in some aspects is provided in any suitable amount, such as a ratio of LCL feeder cells to initial T lymphocytes of at least about 10:1.

In embodiments, antigen-specific T cells, such as antigen-specific CD4+ and/or CD8+ T cells, are obtained by stimulating naive or antigen specific T lymphocytes with antigen. For example, antigen-specific T cell lines or clones can be generated to cytomegalovirus antigens by isolating T cells from infected subjects and stimulating the cells in vitro with the same antigen.

C. Engineered Cells, Vectors and Compositions for Multi-Targeting

Also provided are cells such as engineered cells that can bind to and/or target multiple antigens. In some embodiments, improved selectivity and specificity is achieved through strategies targeting multiple antigens. Such strategies generally involve multiple antigen-binding domains, which typically are present on distinct genetically engineered antigen receptors and specifically bind to distinct antigens. In some embodiments, the cells are engineered with the ability to bind more than one antigen. For example, in some embodiments, the cells are engineered to express multispecific binding molecules. In some embodiments, the cells express multiple binding molecules, e.g., recombinant receptors, each of which can target one antigen or multiple antigens, e.g., one receptor that targets BCMA, such as any described herein, and another receptor that targets another antigen, e.g., tumor antigen. In some aspects, a plurality of genetically engineered antigen receptors are introduced into the cell, which specifically bind to different antigens, each expressed in or on the disease or condition to be targeted with the cells or tissues or cells thereof. Such features can in some aspects address or reduce the likelihood of off-target effects or increase efficacy. For example, where a single antigen expressed in a disease or condition is also expressed on or in non-diseased or normal cells, such multi-targeting approaches can provide selectivity for desired cell types by requiring binding via multiple antigen receptors in order to activate the cell or induce a particular effector function. In some embodiments, a plurality of cells can be engineered to express one or more different binding molecules, e.g., recombinant receptors, each of which can target one antigen or multiple antigens.

Also provided are multispecific cells containing any of the binding molecules described herein, such as cells containing a cell surface protein including the anti-BCMA antibody and an additional cell surface protein, such as an additional chimeric receptor, which binds to a different antigen or a different epitope on BCMA. In some embodiments, provided are compositions of cells that express recombinant receptors, wherein one or more of the binding molecules, multispecific binding molecules and/or recombinant receptors bind and/or target BCMA. In some embodiments, the multispecific binding molecules and/or recombinant receptors target one or more different epitopes on BCMA.

In some embodiments, provided are composition of cells, wherein each type of cell expresses one or more binding molecules, e.g., recombinant receptors. In some embodiments, the cell comprises (e.g., has been transformed with) one or more vectors comprising one or more nucleic acid that encodes one or more an amino acid sequence comprising one or more antibodies and/or portions thereof, e.g., antigen-binding fragments thereof. In some embodiments, one or more such cells are provided. In some embodiments, a composition containing one or more such cells is provided. In some embodiments, the one or more cells can express different antibodies, or the same antibody. In some embodiments, each of the cells expresses one or more antibodies, such as more than one antibody. In some embodiments, each of the cells expresses a multispecific binding molecule, e.g., a multispecific receptor, e.g., CAR.

In some embodiments, the cells include multi-targeting strategies that target BCMA and a second or additional antigen associated with a particular disease or condition. In some embodiments, the second or additional antigen is targeted by a multispecific binding molecule and/or multiple binding molecules and/or a plurality of cells, e.g., one or more cells, each engineered to express one or more recombinant receptors. In some embodiments, a recombinant receptor targeting a second or additional antigen is expressed on the same cell as a BCMA binding molecule, or on a different cell.

In some embodiments, among the second or additional antigens for multi-targeting strategies includes those in which at least one of the antigens is a universal tumor antigen, or a family member thereof. In some embodiments, the second or additional antigen is an antigen expressed on a tumor. In some embodiments, the BCMA-binding molecules provided herein target an antigen on the same tumor type as the second or additional antigen. In some embodiments, the second or additional antigen may also be a universal tumor antigen or may be a tumor antigen specific to a tumor type. In some embodiments, the cell further comprises an additional genetically engineered antigen receptor that recognizes a second or additional antigen expressed on a disease or condition to be treated and induces a stimulatory or activating signal.

Exemplary antigens include CD4, CD5, CD8, CD14, CD15, CD19, CD20, CD21, CD22, CD23, CD25, CD33, CD37, CD38, CD40, CD40L, CD46, CD52, CD54, CD74, CD80, CD126, CD138, B7, MUC-1, Ia, HM1.24, HLA-DR, tenascin, an angiogenesis factor, VEGF, PlGF, ED-B fibronectin, an oncogene, an oncogene product, CD66a-d, necrosis antigens, Ii, IL-2, T101, TAC, IL-6, ROR1, TRAIL-R1 (DR4), TRAIL-R2 (DR5), B cell maturation antigen (BCMA), tEGFR, Her2, L1-CAM, mesothelin, CEA, hepatitis B surface antigen, anti-folate receptor, CD24, CD30, CD44, EGFR, EGP-2, EGP-4, EPHa2, ErbB2, ErbB3, ErbB4, erbB dimers, EGFR vIII, FBP, FCRL5, FCRH5, fetal acetylcholine receptor, GD2, GD3, G protein-coupled receptor class C group 5 member D (GPRC5D), HMW-MAA, IL-22R-alpha, IL-13R-alpha2, kdr, kappa light chain, Lewis Y, L1-cell adhesion molecule (L1-CAM), Melanoma-associated antigen (MAGE)-A1, MAGE-A3, MAGE-A6, Preferentially expressed antigen of melanoma (PRAME), survivin, EGP2, EGP40, TAG72, B7-H6, IL-13 receptor a2 (IL-13Ra2), CA9, CD171, G250/CAIX, HLA-AI MAGE A1, HLA-A2 NY-ESO-1, PSCA, folate receptor-a, CD44v6, CD44v7/8, avb6 integrin, 8H9, NCAM, VEGF receptors, 5T4, Foetal AchR, NKG2D ligands, dual antigen, an antigen associated with a universal tag, a cancer-testes antigen, MUC1, MUC16, NY-ESO-1, MART-1, gp100, oncofetal antigen, VEGF-R2, carcinoembryonic antigen (CEA), prostate specific antigen, PSMA, Her2/neu, estrogen receptor, progesterone receptor, ephrinB2, CD123, c-Met, GD-2, O-acetylated GD2 (OGD2), CE7, Wilms Tumor 1 (WT-1), a cyclin, cyclin A2, CCL-1, hTERT, MDM2, CYP1B, WT1, livin, AFP, p53, cyclin (D1), CS-1, BCMA, BAFF-R, TACI, CD56, TIM-3, CD123, L1-cell adhesion molecule, MAGE-A1, MAGE A3, a cyclin, such as cyclin A1 (CCNA1) and/or a pathogen-specific antigen, biotinylated molecules, molecules expressed by HIV, HCV, HBV and/or other pathogens, and/or in some aspects, neoepitopes or neoantigens thereof. In some embodiments, the antigen is associated with or is a universal tag.

In some embodiments, the plurality of antigens, e.g., the first antigen, e.g., BCMA, and the second or additional antigens, are expressed on the cell, tissue, or disease or condition being targeted, such as on the cancer cell. In some aspects, the cell, tissue, disease or condition is multiple myeloma or a multiple myeloma cell. One or more of the plurality of antigens generally also is expressed on a cell which it is not desired to target with the cell therapy, such as a normal or non-diseased cell or tissue, and/or the engineered cells themselves. In such embodiments, by requiring ligation of multiple receptors to achieve a response of the cell, specificity and/or efficacy is achieved.

In some aspects, the antigen, e.g., the second or additional antigen, such as the disease-specific antigen and/or related antigen, is expressed on multiple myeloma, such as G protein-coupled receptor class C group 5 member D (GPRC5D), CD38 (cyclic ADP ribose hydrolase), CD138 (syndecan-1, syndecan, SYN-1), CS-1 (CS1, CD2 subset 1, CRACC, SLAMF7, CD319, and 19A24), BAFF-R, TACI and/or FcRH5. Other exemplary multiple myeloma antigens include CD56, TIM-3, CD33, CD123, CD44, CD20, CD40, CD74, CD200, EGFR, β2-Microglobulin, HM1.24, IGF-1R, IL-6R, TRAIL-R1, and the activin receptor type IIA (ActRIIA). See Benson and Byrd, J. Clin. Oncol. (2012) 30(16): 2013-15; Tao and Anderson, Bone Marrow Research (2011): 924058; Chu et al., Leukemia (2013) 28(4):917-27; Garfall et al., Discov Med. (2014) 17(91):37-46. In some embodiments, the antigens include those present on lymphoid tumors, myeloma, AIDS-associated lymphoma, and/or post-transplant lymphoproliferations, such as CD38. Antibodies or antigen-binding fragments directed against such antigens are known and include, for example, those described in U.S. Pat. Nos. 8,153,765; 8,603,477, 8,008,450; U.S. Pub. No. US20120189622 or US20100260748; and/or International PCT Publication Nos. WO2006099875, WO2009080829 or WO2012092612 or WO2014210064. In some embodiments, such antibodies or antigen-binding fragments thereof (e.g.

scFv) are contained in multispecific antibodies, multispecific chimeric receptors, such as multispecific CARs, and/or multispecific cells.

In some embodiments, the cells and methods include multi-targeting strategies, such as expression of two or more genetically engineered receptors on the cell, each recognizing a different antigen and typically each including a different intracellular signaling component. Such multi-targeting strategies are described, for example, in International Patent Application, Publication No.: WO 2014055668 A1 (describing combinations of a stimulatory or activating and costimulatory CARs, e.g., targeting two different antigens present individually on off-target, e.g., normal cells, but present together only on cells of the disease or condition to be treated) and Fedorov et al., Sci. Transl. Medicine, 5(215) (December, 2013) (describing cells expressing a stimulatory or an activating and an inhibitory CAR, such as those in which the stimulatory or activating CAR binds to one antigen expressed on both normal or non-diseased cells and cells of the disease or condition to be treated, and the inhibitory CAR binds to another antigen expressed only on the normal cells or cells which it is not desired to treat).

In some embodiments, a plurality of cells, each engineered to express one or more recombinant receptors, are provided. For example, in some embodiments, one cell is engineered to express a binding molecule that binds and/or targets BCMA, and another cell is engineered to express a binding molecule that binds and/or targets an additional or second antigen. In some embodiments, the cells can each express a multispecific binding molecule, e.g., a multispecific recombinant receptor, where one or more of the target antigen is BCMA. In some of such embodiments, the plurality of cells can be administered together or separately. In some embodiments, the plurality of cells are administered simultaneously or concurrently with the cells, e.g., administered on the same day, and/or sequentially with or intermittently with, in any order, another engineered cell in the plurality. For example, in some embodiments, an engineered cell expressing a BCMA-binding molecule, e.g., CAR, is administered simultaneously with or sequentially with, in any order, another engineered cell expressing a binding molecule that binds a different target antigen or a different epitope on BCMA. In some embodiments, the plurality of cells can be in the same composition. Exemplary compositions of the cells include compositions described in Section II below.

IV. PHARMACEUTICAL COMPOSITIONS

Also provided are compositions including the BCMA-binding molecules, immunoconjugates, recombinant receptors, and engineered cells, including pharmaceutical compositions and formulations. Among such compositions are those that include engineered cells, such as a plurality of engineered cells, expressing the provided anti-BCMA recombinant receptors (e.g. CARs).

Provided are pharmaceutical formulations comprising a BCMA-binding recombinant chimeric antigen receptors or engineered cells expressing said receptors, a plurality of engineered cells expressing said receptors and/or additional agents for combination treatment or therapy. The pharmaceutical compositions and formulations generally include one or more optional pharmaceutically acceptable carrier(s) or excipient(s). In some embodiments, the composition includes at least one additional therapeutic agent.

The term "pharmaceutical formulation" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

In some aspects, the choice of carrier is determined in part by the particular cell, binding molecule, and/or antibody, and/or by the method of administration. Accordingly, there are a variety of suitable formulations. For example, the pharmaceutical composition can contain preservatives. Suitable preservatives may include, for example, methylparaben, propylparaben, sodium benzoate, and benzalkonium chloride. In some aspects, a mixture of two or more preservatives is used. The preservative or mixtures thereof are typically present in an amount of about 0.0001% to about 2% by weight of the total composition. Carriers are described, e.g., by Remington's Pharmaceutical Sciences 16th edition, Osol, A. Ed. (1980). Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG).

Buffering agents in some aspects are included in the compositions. Suitable buffering agents include, for example, citric acid, sodium citrate, phosphoric acid, potassium phosphate, and various other acids and salts. In some aspects, a mixture of two or more buffering agents is used. The buffering agent or mixtures thereof are typically present in an amount of about 0.001% to about 4% by weight of the total composition. Methods for preparing administrable pharmaceutical compositions are known. Exemplary methods are described in more detail in, for example, Remington: The Science and Practice of Pharmacy, Lippincott Williams & Wilkins; 21st ed. (May 1, 2005).

Formulations of the antibodies described herein can include lyophilized formulations and aqueous solutions.

The formulation or composition may also contain more than one active ingredient useful for the particular indication, disease, or condition being treated with the binding molecules or cells, preferably those with activities complementary to the binding molecule or cell, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents, e.g., asparaginase, busulfan, carboplatin, cisplatin, daunorubicin, doxorubicin, fluorouracil, gemcitabine, hydroxyurea, methotrexate, paclitaxel, rituximab, vinblastine, vincristine, etc. In some embodiments, the cells or antibodies are administered in the form of a salt, e.g., a pharmaceutically acceptable salt. Suitable pharmaceutically acceptable acid addition salts include those derived from mineral acids, such as hydrochloric, hydrobromic, phosphoric, metaphosphoric, nitric, and sulphuric acids, and organic acids, such as tartaric, acetic, citric, malic, lactic, fumaric, benzoic, glycolic, gluconic, succinic, and arylsulphonic acids, for example, p-toluene-sulphonic acid.

Active ingredients may be entrapped in microcapsules, in colloidal drug delivery systems (for example, liposomes, albumin microspheres, microemulsions, nano-particles and nanocapsules) or in macroemulsions. In certain embodiments, the pharmaceutical composition is formulated as an inclusion complex, such as cyclodextrin inclusion complex, or as a liposome. Liposomes can serve to target the host cells (e.g., T-cells or NK cells) to a particular tissue. Many methods are available for preparing liposomes, such as those described in, for example, Szoka et al., Ann. Rev. Biophys. Bioeng., 9: 467 (1980), and U.S. Pat. Nos. 4,235,871, 4,501,728, 4,837,028, and 5,019,369.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

The pharmaceutical composition in some embodiments contains the binding molecules and/or cells in amounts effective to treat or prevent the disease or condition, such as a therapeutically effective or prophylactically effective amount. Therapeutic or prophylactic efficacy in some embodiments is monitored by periodic assessment of treated subjects. For repeated administrations over several days or longer, depending on the condition, the treatment is repeated until a desired suppression of disease symptoms occurs. However, other dosage regimens may be useful and can be determined. The desired dosage can be delivered by a single bolus administration of the composition, by multiple bolus administrations of the composition, or by continuous infusion administration of the composition.

In certain embodiments, in the context of genetically engineered cells containing the binding molecules, e.g., CAR, a subject is administered the range of about one million to about 100 billion cells, such as, e.g., 1 million to about 50 billion cells (e.g., about 5 million cells, about 25 million cells, about 500 million cells, about 1 billion cells, about 5 billion cells, about 20 billion cells, about 30 billion cells, about 40 billion cells, or a range defined by any two of the foregoing values), such as about 10 million to about 100 billion cells (e.g., about 20 million cells, about 30 million cells, about 40 million cells, about 60 million cells, about 70 million cells, about 80 million cells, about 90 million cells, about 10 billion cells, about 25 billion cells, about 50 billion cells, about 75 billion cells, about 90 billion cells, or a range defined by any two of the foregoing values), and in some cases about 100 million cells to about 50 billion cells (e.g., about 120 million cells, about 250 million cells, about 350 million cells, about 450 million cells, about 650 million cells, about 800 million cells, about 900 million cells, about 3 billion cells, about 30 billion cells, about 45 billion cells) or any value in between these ranges, and/or such a number of cells per kilogram of body weight of the subject. In some aspects, in the context of genetically engineered cells expressing the binding molecules, e.g., CAR, a composition can contain at least the number of cells for administration for a dose of cell therapy, such as about or at least a number of cells described herein for administration, e.g., in Section V.A.

The may be administered using standard administration techniques, formulations, and/or devices. Provided are formulations and devices, such as syringes and vials, for storage and administration of the compositions. Administration of the cells can be autologous or heterologous. For example, immunoresponsive cells or progenitors can be obtained from one subject, and administered to the same subject or a different, compatible subject. Peripheral blood derived immunoresponsive cells or their progeny (e.g., in vivo, ex vivo or in vitro derived) can be administered via localized injection, including catheter administration, systemic injection, localized injection, intravenous injection, or parenteral administration. When administering a therapeutic composition (e.g., a pharmaceutical composition containing a genetically modified immunoresponsive cell), it will generally be formulated in a unit dosage injectable form (solution, suspension, emulsion).

Formulations include those for oral, intravenous, intraperitoneal, subcutaneous, pulmonary, transdermal, intramuscular, intranasal, buccal, sublingual, or suppository administration. In some embodiments, the cell populations are administered parenterally. The term "parenteral," as used herein, includes intravenous, intramuscular, subcutaneous, rectal, vaginal, intracranial, intrathoracic, and intraperitoneal administration. In some embodiments, the cell populations are administered to a subject using peripheral systemic delivery by intravenous, intraperitoneal, or subcutaneous injection.

Compositions in some embodiments are provided as sterile liquid preparations, e.g., isotonic aqueous solutions, suspensions, emulsions, dispersions, or viscous compositions, which may in some aspects be buffered to a selected pH. Liquid preparations are normally easier to prepare than gels, other viscous compositions, and solid compositions. Additionally, liquid compositions are somewhat more convenient to administer, especially by injection. Viscous compositions, on the other hand, can be formulated within the appropriate viscosity range to provide longer contact periods with specific tissues. Liquid or viscous compositions can comprise carriers, which can be a solvent or dispersing medium containing, for example, water, saline, phosphate buffered saline, polyol (for example, glycerol, propylene glycol, liquid polyethylene glycol) and suitable mixtures thereof.

Sterile injectable solutions can be prepared by incorporating the binding molecule in a solvent, such as in admixture with a suitable carrier, diluent, or excipient such as sterile water, physiological saline, glucose, dextrose, or the like. The compositions can also be lyophilized. The compositions can contain auxiliary substances such as wetting, dispersing, or emulsifying agents (e.g., methylcellulose), pH buffering agents, gelling or viscosity enhancing additives, preservatives, flavoring agents, colors, and the like, depending upon the route of administration and the preparation desired. Standard texts may in some aspects be consulted to prepare suitable preparations.

Various additives which enhance the stability and sterility of the compositions, including antimicrobial preservatives, antioxidants, chelating agents, and buffers, can be added. Prevention of the action of microorganisms can be ensured by various antibacterial and antifungal agents, for example, parabens, chlorobutanol, phenol, sorbic acid, and the like. Prolonged absorption of the injectable pharmaceutical form can be brought about by the use of agents delaying absorption, for example, aluminum monostearate and gelatin.

Sustained-release preparations may be prepared. Suitable examples of sustained-release preparations include semipermeable matrices of solid hydrophobic polymers containing the antibody, which matrices are in the form of shaped articles, e.g. films, or microcapsules.

The formulations to be used for in vivo administration are generally sterile. Sterility may be readily accomplished, e.g., by filtration through sterile filtration membranes.

Also provided are pharmaceutical compositions for combination therapy. Any of the additional agents for combination therapy described herein, such as agents described in Section III.B, can be prepared and administered as one or more pharmaceutical compositions, with the BCMA-binding molecule (e.g., antibody), immunoconjugate, recombinant receptor (e.g., chimeric antigen receptor) and/or engineered cells expressing said molecules (e.g., recombinant receptor) described herein. The combination therapy can be administered in one or more pharmaceutical compositions, e.g., where the binding molecules, recombinant receptors and/or cells are in the same pharmaceutical composition as the additional agent, or in separate pharmaceutical compositions. For example, in some embodiments, the additional agent is an additional engineered cell, e.g., cell engineered to express a different recombinant receptor, and is administered in the same composition or in a separate composition. In some embodiments, each of the pharmaceutical composition is formulated in a suitable formulation according to the particular binding molecule, recombinant receptor, cell, e.g., engineered cell, and/or additional agent, and the particular dosage regimen and/or method of delivery.

V. METHODS AND USES

Also provided methods of using and uses of the BCMA-binding molecules, immunoconjugates, recombinant receptors, engineered cells, and pharmaceutical compositions and formulations thereof, such as in the treatment of diseases, conditions, and disorders in which BCMA is expressed, and/or detection, diagnostic, and prognostic methods. Among such methods, such as methods of treatment, and uses are those that involve administering to a subject engineered cells, such as a plurality of engineered cells, expressing the provided anti-BCMA recombinant receptors (e.g. CARs). Also provided are methods of combination therapy and/or treatment.

A. Therapeutic and Prophylactic Methods and Uses

Also provided are methods of administering and uses, such as therapeutic and prophylactic uses, of the BCMA-binding molecules, including the anti-BCMA recombinant receptors (e.g., CARs), engineered cells expressing the recombinant receptors (e.g., CARs), plurality of engineered cells expressing the receptors, and/or compositions comprising the same. Such methods and uses include therapeutic methods and uses, for example, involving administration of the molecules (e.g., recombinant receptors), cells (e.g., engineered cells), or compositions containing the same, to a subject having a disease, condition, or disorder associated with BCMA such as a disease, condition, or disorder associated with BCMA expression, and/or in which cells or tissues express, e.g., specifically express, BCMA. In some embodiments, the molecule, cell, and/or composition is/are administered in an effective amount to effect treatment of the disease or disorder. Provided herein are uses of the recombinant receptors (e.g., CARs), and cells (e.g., engineered cells) in such methods and treatments, and in the preparation of a medicament in order to carry out such therapeutic methods. In some embodiments, the methods are carried out by administering the binding molecules or cells, or compositions comprising the same, to the subject having, having had, or suspected of having the disease or condition. In some embodiments, the methods thereby treat the disease or condition or disorder in the subject. Also provided herein are of use of any of the compositions, such as pharmaceutical compositions provided herein, for the treatment of a disease or disorder associated with BCMA, such as use in a treatment regimen.

As used herein, "treatment" (and grammatical variations thereof such as "treat" or "treating") refers to complete or partial amelioration or reduction of a disease or condition or disorder, or a symptom, adverse effect or outcome, or phenotype associated therewith. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. The terms do not imply complete curing of a disease or complete elimination of any symptom or effect(s) on all symptoms or outcomes.

As used herein, "delaying development of a disease" means to defer, hinder, slow, retard, stabilize, suppress and/or postpone development of the disease (such as cancer). This delay can be of varying lengths of time, depending on the history of the disease and/or subject being treated. As sufficient or significant delay can, in effect, encompass prevention, in that the subject does not develop the disease. For example, a late stage cancer, such as development of metastasis, may be delayed.

"Preventing," as used herein, includes providing prophylaxis with respect to the occurrence or recurrence of a disease in a subject that may be predisposed to the disease but has not yet been diagnosed with the disease. In some embodiments, the provided molecules and compositions are used to delay development of a disease or to slow the progression of a disease.

As used herein, to "suppress" a function or activity is to reduce the function or activity when compared to otherwise same conditions except for a condition or parameter of interest, or alternatively, as compared to another condition. For example, an antibody or composition or cell which suppresses tumor growth reduces the rate of growth of the tumor compared to the rate of growth of the tumor in the absence of the antibody or composition or cell.

An "effective amount" of an agent, e.g., a pharmaceutical formulation, binding molecule, antibody, cells, or composition, in the context of administration, refers to an amount effective, at dosages/amounts and for periods of time necessary, to achieve a desired result, such as a therapeutic or prophylactic result.

A "therapeutically effective amount" of an agent, e.g., a pharmaceutical formulation, binding molecule, antibody, cells, or composition refers to an amount effective, at dosages and for periods of time necessary, to achieve a desired therapeutic result, such as for treatment of a disease, condition, or disorder, and/or pharmacokinetic or pharmacodynamic effect of the treatment. The therapeutically effective amount may vary according to factors such as the disease state, age, sex, and weight of the subject, and the populations of cells administered. In some embodiments, the provided methods involve administering the molecules, antibodies, cells, and/or compositions at effective amounts, e.g., therapeutically effective amounts.

A "prophylactically effective amount" refers to an amount effective, at dosages and for periods of time necessary, to achieve the desired prophylactic result. Typically but not necessarily, since a prophylactic dose is used in subjects prior to or at an earlier stage of disease, the prophylactically effective amount will be less than the therapeutically effective amount.

As used herein, a "subject" or an "individual" is a mammal. In some embodiments, a "mammal" includes humans, non-human primates, domestic and farm animals, and zoo, sports, or pet animals, such as dogs, horses, rabbits, cattle, pigs, hamsters, gerbils, mice, ferrets, rats, cats, monkeys, etc. In some embodiments, the subject is human.

Methods for administration of cells for adoptive cell therapy are known and may be used in connection with the provided methods and compositions. For example, adoptive T cell therapy methods are described, e.g., in US Pat. App. Pub. No. 2003/0170238 to Gruenberg et al; U.S. Pat. No. 4,690,915 to Rosenberg; Rosenberg (2011) Nat Rev Clin Oncol. 8(10):577-85). See, e.g., Themeli et al. (2013) Nat Biotechnol. 31(10): 928-933; Tsukahara et al. (2013) Biochem Biophys Res Commun 438(1): 84-9; Davila et al. (2013) PLoS ONE 8(4): e61338.

Among the diseases to be treated is any disease or disorder associated with BCMA or any disease or disorder in which BCMA is specifically expressed and/or in which BCMA has been targeted for treatment (also referred to herein interchangeably as a "BCMA-associated disease or disorder"). Cancers associated with BCMA expression include hematologic malignancies such as multiple myeloma, Waldenstrom macroglobulinemia, as well as both Hodgkin's and non-Hodgkin's lymphomas. See Coquery et al., *Crit Rev Immunol.*, 2012, 32(4):287-305 for a review of BCMA. Since BCMA has been implicated in mediating tumor cell survival, it is a potential target for cancer therapy. Chimeric antigen receptors containing mouse anti-human BCMA antibodies and cells expressing such chimeric receptors have been previously described. See Carpenter et al., *Clin Cancer Res.*, 2013, 19(8):2048-2060.

In some embodiments, the disease or disorder associated with BCMA is a B cell-related disorder. In some embodiments, the disease or disorder associated with BCMA is one or more diseases or conditions from among glioblastoma, lymphomatoid granulomatosis, post-transplant lymphoproliferative disorder, an immunoregulatory disorder, heavy-chain disease, primary or immunocyte-associated amyloidosis, or monoclonal gammopathy of undetermined significance.

In some embodiments, the disease or disorder associated with BCMA is an autoimmune disease or disorder. Such autoimmune diseases or disorder include, but are not limited to, systemic lupus erythematosus (SLE), lupus nephritis, inflammatory bowel disease, rheumatoid arthritis (e.g., juvenile rheumatoid arthritis), ANCA associated vasculitis, idiopathic thrombocytopenia purpura (ITP), thrombotic thrombocytopenia purpura (TTP), autoimmune thrombocytopenia, Chagas' disease, Grave's disease, Wegener's granulomatosis, polyarteritis nodosa, Sjogren's syndrome, pemphigus vulgaris, scleroderma, multiple sclerosis, psoriasis, IgA nephropathy, IgM polyneuropathies, vasculitis, diabetes mellitus, Reynaud's syndrome, anti-phospholipid syndrome, Goodpasture's disease, Kawasaki disease, autoimmune hemolytic anemia, myasthenia gravis, or progressive glomerulonephritis.

In certain diseases and conditions, BCMA is expressed on malignant cells and cancers. In some embodiments, the cancer (e.g., a BCMA-expressing cancer) is a B cell malignancy. In some embodiments, the cancer (e.g., a BCMA-expressing cancer) is a lymphoma, a leukemia, or a plasma cell malignancy. Lymphomas contemplated herein include, but are not limited to, Burkitt lymphoma (e.g., endemic Burkitt's lymphoma or sporadic Burkitt's lymphoma), non-Hodgkin's lymphoma (NHL), Hodgkin's lymphoma, Waldenstrom macroglobulinemia, follicular lymphoma, small non-cleaved cell lymphoma, mucosa-associated lymphatic tissue lymphoma (MALT), marginal zone lymphoma, splenic lymphoma, nodal monocytoid B cell lymphoma, immunoblastic lymphoma, large cell lymphoma, diffuse mixed cell lymphoma, pulmonary B cell angiocentric lymphoma, small lymphocytic lymphoma, primary mediastinal B cell lymphoma, lymphoplasmacytic lymphoma (LPL), or mantle cell lymphoma (MCL). Leukemias contemplated here, include, but are not limited to, chronic lymphocytic leukemia (CLL), plasma cell leukemia or acute lymphocytic leukemia (ALL). Also contemplated herein are plasma cell malignancies including, but not limited to, multiple myeloma (e.g., non-secretory multiple myeloma, smoldering multiple myeloma) or plasmacytoma. In some embodiments the disease or condition is multiple myeloma (MM), such as relapsed and/or refractory multiple myeloma (R/R MM). Among the diseases, disorders or conditions associated with BCMA (e.g., a BCMA-expressing cancer) that can be treated include, but are not limited to, neuroblastoma, renal cell carcinoma, colon cancer, colorectal cancer, breast cancer, epithelial squamous cell cancer, melanoma, myeloma (e.g., multiple myeloma), stomach cancer, brain cancer, lung cancer, pancreatic cancer, cervical cancer, ovarian cancer, liver cancer, bladder cancer, prostate cancer, testicular cancer, thyroid cancer, uterine cancer, adrenal cancer and head and neck cancer.

In some embodiments, the methods may identify a subject who has, is suspected to have, or is at risk for developing a BCMA-associated disease or disorder. Hence, provided are methods for identifying subjects with diseases or disorders associated with elevated BCMA expression and selecting them for treatment with a provided BCMA-binding e recombinant receptors (e.g., CARs), and/or engineered cells expressing the recombinant receptors.

For example, a subject may be screened for the presence of a disease or disorder associated with elevated BCMA expression, such as a BCMA-expressing cancer. In some embodiments, the methods include screening for or detecting the presence of a BCMA-associated disease, e.g. a tumor. Thus, in some aspects, a sample may be obtained from a patient suspected of having a disease or disorder associated with elevated BCMA expression and assayed for the expression level of BCMA. In some aspects, a subject who tests positive for a BCMA-associated disease or disorder may be selected for treatment by the present methods, and may be administered a therapeutically effective amount of a recombinant receptor (e.g., CAR) comprising a BCMA-binding molecule, cells containing a recombinant receptor or a pharmaceutical composition thereof as described herein.

In some embodiments, the subject has persistent or relapsed disease, e.g., following treatment with another BCMA-specific antibody and/or cells expressing a BCMA-targeting chimeric receptor and/or other therapy, including chemotherapy, radiation, and/or hematopoietic stem cell transplantation (HSCT), e.g., allogeneic HSCT or autologous HSCT. In some embodiments, the administration effectively treats the subject despite the subject having become resistant to another BCMA-targeted therapy. In some embodiments, the subject has not relapsed but is determined to be at risk for relapse, such as at a high risk of relapse, and thus the compound or composition is administered prophylactically, e.g., to reduce the likelihood of or prevent relapse.

In some embodiments, the subject is one that is eligible for a transplant, such as is eligible for a hematopoietic stem cell transplantation (HSCT), e.g., allogeneic HSCT or autologous HSCT. In some such embodiments, the subject has not previously received a transplant, despite being eligible, prior to administration of the BCMA-binding molecules, including the anti-BCMA recombinant receptors (e.g., CARs), engineered cells expressing the recombinant receptors (e.g., CARs), plurality of engineered cells expressing the receptors, and/or compositions comprising the same, as provided herein.

In some embodiments, the subject is one that is not eligible for a transplant, such as is not eligible for a hematopoietic stem cell transplantation (HSCT), e.g., allogenic HSCT or autologous HSCT. In some such embodiments, such a subject is administered the BCMA-binding molecules, including the anti-BCMA recombinant receptors (e.g., CARs), engineered cells expressing the recombinant receptors (e.g., CARs), plurality of engineered cells expressing the receptors, and/or compositions comprising the same, according to the provided embodiments herein.

In some embodiments, prior to the initiation of administration of the engineered cells, the subject has received one or more prior therapies. In some embodiments, the subject has received at least 1, 2, 3, 4, 5, 6, 7, 8, 9, 10, 11, 12, 13, 14, 15, 16, 17, 18, 19 or 20 or more prior therapies. In some embodiments, the subject has received at least 3, 4, 5, 6, 7, 8, 9, 10 or more prior therapies.

In some aspects, the subject has relapsed or has been refractory to the one or more prior therapies. In some aspects, the prior therapies include treatment with autologous stem cell transplant (ASCT); an immunomodulatory agent; a proteasome inhibitor; and an anti-CD38 antibody; unless the subject was not a candidate for or was contraindicated for one or more of the therapies. In some embodiments, the immunomodulatory agent is selected from among thalidomide, lenalidomide or pomalidomide. In some embodiments, the proteasome inhibitor is selected from among bortezomib, carfilzomib or ixazomib. In some embodiments, the anti-CD38 antibody is or comprises daratumumab. In some embodiments, the subject must have undergone at least 2 consecutive cycles of treatment for each regimen unless progressive disease was the best response to the regimen.

In some embodiments, the method can involve including or excluding particular subjects for therapy with the provided anti-BCMA antibodies, recombinant receptors and/or cells comprising such receptors, based on particular criteria, diagnosis or indication. In some embodiments, at the time of administration of the dose of cells or pre-treatment lymphodepleting chemotherapy, the subject has not had active or history of plasma cell leukemia (PCL). In some embodiments, if the subject had active or a history of PCL at the time of administration, the subject can be excluded from being treated according to the provided methods. In some embodiments, if the subject develops a PCL, such as secondary PCL, at the time of administration, the subject can be excluded from being treated according to the provided methods. In some embodiments, the assessment for the criteria, diagnosis or indication can be performed at the time of screening the subjects for eligibility or suitability of treatment according to the provided methods, at various steps of the treatment regimen, at the time of receiving lymphodepleting therapy, and/or at or immediately prior to the initiation of administration of the engineered cells or composition thereof.

In some embodiments, the treatment does not induce an immune response by the subject to the therapy, and/or does not induce such a response to a degree that prevents effective treatment of the disease or condition. In some aspects, the degree of immunogenicity and/or graft versus host response is less than that observed with a different but comparable treatment. For example, in the case of adoptive cell therapy using cells expressing CARs including the provided anti-BCMA antibodies, the degree of immunogenicity in some embodiments is reduced compared to CARs including a different antibody that binds to a similar, e.g., overlapping epitope and/or that competes for binding to BCMA with the antibody, such as a mouse or monkey or rabbit or humanized antibody.

In some embodiments, the methods include adoptive cell therapy, whereby genetically engineered cells expressing the provided recombinant receptors comprising a BCMA-binding molecule (e.g., CARs comprising anti-BCMA antibody or antigen-binding fragment thereof) are administered to subjects. Such administration can promote activation of the cells (e.g., T cell activation) in a BCMA-targeted manner, such that the cells of the disease or disorder are targeted for destruction.

Thus, the provided methods and uses include methods and uses for adoptive cell therapy. In some embodiments, the methods include administration of the cells or a composition containing the cells to a subject, tissue, or cell, such as one having, at risk for, or suspected of having the disease, condition or disorder. In some embodiments, the cells, populations, and compositions are administered to a subject having the particular disease or condition to be treated, e.g., via adoptive cell therapy, such as adoptive T cell therapy. In some embodiments, the cells or compositions are administered to the subject, such as a subject having or at risk for the disease or condition. In some aspects, the methods thereby treat, e.g., ameliorate one or more symptom of the disease or condition, such as by lessening tumor burden in a BCMA-expressing cancer.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10):577-85). See, e.g., Themeli et al. (2013) Nat Biotechnol. 31(10): 928-933; Tsukahara et al. (2013) Biochem Biophys Res Commun 438(1): 84-9; Davila et al. (2013) PLoS ONE 8(4): e61338.

In some embodiments, the cell therapy, e.g., adoptive cell therapy, e.g., adoptive T cell therapy, is carried out by autologous transfer, in which the cells are isolated and/or otherwise prepared from the subject who is to receive the cell therapy, or from a sample derived from such a subject. Thus, in some aspects, the cells are derived from a subject, e.g., patient, in need of a treatment and the cells, following isolation and processing are administered to the same subject.

In some embodiments, the cell therapy, e.g., adoptive cell therapy, e.g., adoptive T cell therapy, is carried out by allogeneic transfer, in which the cells are isolated and/or otherwise prepared from a subject other than a subject who is to receive or who ultimately receives the cell therapy, e.g., a first subject. In such embodiments, the cells then are administered to a different subject, e.g., a second subject, of the same species. In some embodiments, the first and second subjects are genetically identical. In some embodiments, the first and second subjects are genetically similar. In some embodiments, the second subject expresses the same HLA class or supertype as the first subject.

In some embodiments, the subject, to whom the cells, cell populations, or compositions are administered, is a primate, such as a human. In some embodiments, the subject, to whom the cells, cell populations, or compositions are administered, is a non-human primate. In some embodiments, the non-human primate is a monkey (e.g., cynomolgus monkey) or an ape. The subject can be male or female and can be any suitable age, including infant, juvenile, adolescent, adult, and geriatric subjects. In some embodiments, the subject is a non-primate mammal, such as a rodent (e.g., mouse, rat, etc.). In some examples, the patient or subject is a validated animal model for disease, adoptive cell therapy, and/or for assessing toxic outcomes such as cytokine release syndrome (CRS).

The BCMA-binding molecules such as recombinant receptors (e.g., CARs) and cells expressing the same, can be administered by any suitable means, for example, by injection, e.g., intravenous or subcutaneous injections, intraocular injection, periocular injection, subretinal injection, intravitreal injection, trans-septal injection, subscleral injection, intrachoroidal injection, intracameral injection, subconjunctival injection, subconjunctival injection, sub-Tenon's injection, retrobulbar injection, peribulbar injection, or posterior juxtascleral delivery. In some embodiments, they are administered by parenteral, intrapulmonary, and intranasal, and, if desired for local treatment, intralesional administration. Parenteral infusions include intramuscular, intravenous, intraarterial, intraperitoneal, intracranial, intrathoracic, or subcutaneous administration. Dosing and administration may depend in part on whether the administration is brief or chronic. Various dosing schedules include but are not limited to single or multiple administrations over various timepoints, bolus administration, and pulse infusion.

For the prevention or treatment of disease, the appropriate dosage of the binding molecule, recombinant receptor or cell may depend on the type of disease to be treated, the type of binding molecule or recombinant receptor, the severity and course of the disease, whether the binding molecule or recombinant receptor is administered for preventive or therapeutic purposes, previous therapy, the patient's clinical history and response to the recombinant receptor or cell, and the discretion of the attending physician. The compositions and molecules and cells are in some embodiments suitably administered to the patient at one time or over a series of treatments.

In some embodiments, the dose and/or frequency of administration is determined based on efficacy and/or response. In some embodiments, efficacy is determined by evaluating disease status. Exemplary methods for assessing disease status include: measurement of M protein in biological fluids, such as blood and/or urine, by electrophoresis and immunofixation; quantification of sFLC ($\kappa$ and $\lambda$) in blood; skeletal survey; and imaging by positron emission tomography (PET)/computed tomography (CT) in subjects with extramedullary disease. In some embodiments, disease status can be evaluated by bone marrow examination. In some examples, dose and/or frequency of administration is determined by the expansion and persistence of the recombinant receptor or cell in the blood and/or bone marrow. In some embodiments, dose and/or frequency of administration is determined based on the antitumor activity of the recombinant receptor or engineered cell. In some embodiments antitumor activity is determined by the overall response rate (ORR) and/or International Myeloma Working Group (IMWG) Uniform Response Criteria (see Kumar et al. (2016) Lancet Oncol 17(8):e328-346). In some embodiments, response is evaluated using minimal residual disease (MRD) assessment. In some embodiments, MRD can be assessed by methods such as flow cytometry and high-throughput sequencing, e.g., deep sequencing. In some embodiments, response is evaluated based on the duration of response following administration of the recombinant receptor or cells. In some examples, dose and/or frequency of administration can be based on toxicity. In some embodiments, dose and/or frequency can be determined based on health-related quality of life (HRQoL) of the subject to which the recombinant receptor and/or cells is/are administered. In some embodiments, dose and/or frequency of administration can be changed, i.e., increased or decreased, based on any of the above criteria.

In some embodiments, the disease or disorder to be treated is multiple myeloma. In some embodiments, measurable disease criteria for multiple myeloma can include (1) serum M-protein 1 g/dL or greater; (2) Urine M-protein 200 mg or greater/24 hour; (3) involved serum free light chain (sFLC) level 10 mg/dL or greater, with abnormal $\kappa$ to $\lambda$, ratio. In some cases, light chain disease is acceptable only for subjects without measurable disease in the serum or urine.

In some embodiments, the Eastern Cooperative Oncology Group (ECOG) performance status indicator can be used to assess or select subjects for treatment, e.g., subjects who have had poor performance from prior therapies (see, e.g., Oken et al. (1982) Am J Clin Oncol. 5:649-655). The ECOG Scale of Performance Status describes a patient's level of functioning in terms of their ability to care for themselves, daily activity, and physical ability (e.g., walking, working, etc.). In some embodiments, an ECOG performance status of 0 indicates that a subject can perform normal activity. In some aspects, subjects with an ECOG performance status of 1 exhibit some restriction in physical activity but the subject is fully ambulatory. In some aspects, patients with an ECOG performance status of 2 is more than 50% ambulatory. In some cases, the subject with an ECOG performance status of 2 may also be capable of selfcare; see e.g., Sørensen et al., (1993) Br J Cancer 67(4) 773-775. In some embodiments, the subject that are to be administered according to the methods or treatment regimen provided herein include those with an ECOG performance status of 0 or 1.

In some embodiments, the administration can treat the subject despite the subject having become resistant to another therapy. In some embodiments, when administered to subjects according to the embodiments described herein, the dose or the composition is capable of achieving objective response (OR), in at least 50%, 60%, 70%, 80%, 90%, or 95% of subjects that were administered. In some embodiments, OR includes subjects who achieve stringent complete response (sCR), complete response (CR), very good partial response (VGPR), partial response (PR) and minimal response (MR). In some embodiments, when administered to subjects according to the embodiments described herein, the dose or the composition is capable of achieving stringent complete response (sCR), complete response (CR), very good partial response (VGPR) or partial response (PR), in at least 50%, 60%, 70%, 80%, or 85% of subjects that were administered. In some embodiments, when administered to subjects according to the embodiments described herein, the dose or the composition is capable of achieving stringent complete response (sCR) or complete response (CR) at least 20%, 30%, 40% 50%, 60% or 70% of subjects that were administered. In some embodiments, exemplary doses include about $5.0 \times 10^7$, $1.5 \times 10^8$, $3.0 \times 10^8$ or $4.5 \times 10^8$ CAR-expressing T cells. In some aspects, particular response to the treatment, e.g., according to the methods provided herein, can be assessed based on the International Myeloma Working Group (IMWG) Uniform Response Criteria (see Kumar et al. (2016) Lancet Oncol 17(8):e328-346). In some embodiments, exemplary doses to achieve particular outcomes, such as OR, includes about $5.0 \times 10^7$ CAR-expressing T cells.

In some embodiments, toxicity and/or side-effects of treatment can be monitored and used to adjust dose and/or frequency of administration of the recombinant receptor, e.g., CAR, cells, and or compositions. For example, adverse events and laboratory abnormalities can be monitored and used to adjust dose and/or frequency of administration. Adverse events include infusion reactions, cytokine release syndrome (CRS), neurotoxicity, macrophage activation syndrome, and tumor lysis syndrome (TLS). Any of such events can establish dose-limiting toxicities and warrant decrease in dose and/or a termination of treatment. Other side effects or adverse events which can be used as a guideline for establishing dose and/or frequency of administration include non-hematologic adverse events, which include but are not limited to fatigue, fever or febrile neutropenia, increase in transaminases for a set duration (e.g., less than or equal to 2 weeks or less than or equal to 7 days), headache, bone pain, hypotension, hypoxia, chills, diarrhea, nausea/vomiting, neurotoxicity (e.g., confusion, aphasia, seizures, convulsions, lethargy, and/or altered mental status), disseminated intravascular coagulation, other asymptomatic non-hematological clinical laboratory abnormalities, such as electrolyte abnormalities. Other side effects or adverse events which can be used as a guideline for establishing dose and/or frequency of administration include hematologic adverse events, which include but are not limited to neutropenia, leukopenia, thrombocytopenia, animal, and/or B-cell aplasia and hypogammaglobinemia.

In some embodiments, treatment according to the provided methods can result in a lower rate and/or lower degree of toxicity, toxic outcome or symptom, toxicity-promoting profile, factor, or property, such as a symptom or outcome associated with or indicative of cytokine release syndrome (CRS) or neurotoxicity, such as severe CRS or severe neurotoxicity, for example, compared to administration of other therapies.

In certain embodiments, in the context of genetically engineered cells containing the binding molecules or recombinant receptors, a subject is administered the range of about one million to about 100 billion cells and/or that amount of cells per kilogram of body weight, such as, e.g., about 1 million to about 50 billion cells (e.g., about 5 million cells, about 25 million cells, about 500 million cells, about 1 billion cells, about 5 billion cells, about 20 billion cells, about 30 billion cells, about 40 billion cells, or a range defined by any two of the foregoing values), such as about 10 million to about 100 billion cells (e.g., about 20 million cells, about 25 million cells, about 30 million cells, about 40 million cells, about 50 million cells, about 60 million cells, about 70 million cells, about 80 million cells, about 90 million cells, about 10 billion cells, about 25 billion cells, about 50 billion cells, about 75 billion cells, about 90 billion cells, or a range defined by any two of the foregoing values), and in some cases about 100 million cells to about 50 billion cells (e.g., about 120 million cells, about 150 million cells, about 250 million cells, about 300 million cells, about 350 million cells, about 450 million cells, about 500 million cells, about 600 million cells, about 650 million cells, about 800 million cells, about 900 million cells, about 1 billion cells, about 1.2 billion cells, about 3 billion cells, about 30 billion cells, about 45 billion cells, or about 50 billion cells) or any value in between these ranges and/or per kilogram of body weight. Again, dosages may vary depending on attributes particular to the disease or disorder and/or patient and/or other treatments.

In some embodiments, the methods comprises administering a dose of the engineered cells or a composition comprising a dose of the engineered cells. In some embodiments, the engineered cells or compositions containing engineered cells can be used in a treatment regimen, wherein the treatment regimen comprises administering a dose of the engineered cells or a composition comprising a dose of the engineered cells. In some embodiments, the dose can contain, for example, a particular number or range of recombinant receptor-expressing T cells, total T cells, or total peripheral blood mononuclear cells (PBMCs), such as any number of such cells described herein. In some embodiments, a composition containing a dose of the cells can be administered. In some aspects, the number, amount or proportion of CAR-expressing cells in a cell population or a cell composition can be assessed by detection of a surrogate marker, e.g., by flow cytometry or other means, or by detecting binding of a labelled molecule, such as a labelled antigen, that can specifically bind to the binding molecules or receptors provided herein.

In some embodiments, for example, where the subject is a human, the dose includes more than about $1 \times 10^6$ total recombinant receptor (e.g., CAR)-expressing cells, T cells, or peripheral blood mononuclear cells (PBMCs) and fewer than about $2 \times 10^9$ total recombinant receptor (e.g., CAR)-expressing cells, T cells, or peripheral blood mononuclear cells (PBMCs), e.g., in the range of about $2.5 \times 10^7$ to about $1.2 \times 10^9$ such cells, such as $2.5 \times 10^7$, $5 \times 10^7$, $1.5 \times 10^8$, $3 \times 10^8$, $4.5 \times 10^8$, $8 \times 10^8$, or $1.2 \times 10^9$ total such cells, or the range between any two of the foregoing values.

In some embodiments, the dose of genetically engineered cells comprises between at or about $2.5 \times 10^7$ CAR-expressing T cells, total T cells, or total peripheral blood mononuclear cells (PBMCs), and at or about $1.2 \times 10^9$ CAR-expressing T cells, total T cells, or total PBMCs, between at or about $5.0 \times 10^7$ CAR-expressing T cells and at or about $4.5 \times 10^8$ CAR-expressing T cells, total T cells, or total peripheral blood mononuclear cells (PBMCs), between at or about $1.5 \times 10^8$ CAR-expressing T cells and at or about $3.0 \times 10^8$ CAR-expressing T cells, total T cells, or total PBMCs, each inclusive. In some embodiments, the number is with reference to the total number of CD3+ or CD8+, in some cases also CAR-expressing (e.g. CAR+) cells. In some embodiments, the dose comprises a number of cell from or from about $2.5 \times 10^7$ to or to about $1.2 \times 10^9$ CD3+ or CD8+ total T cells or CD3+ or CD8+ CAR-expressing cells, from or from about $5.0 \times 10^7$ to or to about $4.5 \times 10^8$ CD3+ or CD8+ total T cells or CD3+ or CD8+ CAR-expressing cells, or from or from about $1.5 \times 10^8$ to or to about $3.0 \times 10^8$ CD3+ or CD8+ total T cells or CD3+ or CD8+ CAR-expressing cells, each inclusive.

In some embodiments, the T cells of the dose include CD4+ T cells, CD8+ T cells or CD4+ and CD8+ T cells.

In some embodiments, for example, where the subject is human, the CD8+ T cells of the dose, including in a dose including CD4+ and CD8+ T cells, includes between at or about 1×10$^6$ and at or about 2×10$^9$ total recombinant receptor (e.g., CAR)-expressing CD8+ cells, e.g., in the range of at or about 5×10$^7$ to at or about 4.5×10$^8$ such cells, such as at or about 2.5×10$^7$, at or about 5×10$^7$, at or about 1.5×10$^8$, at or about 3×10$^8$, at or about 4.5×10$^8$, at or about 8×10$^8$, or at or about 1.2×10$^9$ total such cells, or the range between any two of the foregoing values.

In some embodiments, the dose of cells, e.g., recombinant receptor-expressing T cells, is administered to the subject as a single dose or is administered only one time within a period of two weeks, one month, three months, six months, 1 year or more. In some embodiments, the patient is administered multiple doses, and each of the doses or the total dose can be within any of the foregoing values. In some embodiments, the engineered cells for administration or composition of engineered cells for administration, exhibits properties indicative of or consistent with cell health. In some embodiments, at or about or at least at or about 70, 75, 80, 85, or 90% CAR+ cells of such dose exhibit one or more properties or phenotypes indicative of cell health or biologically active CAR cell, such as absence expression of an apoptotic marker.

In particular embodiments, the phenotype is or includes an absence of apoptosis and/or an indication the cell is undergoing the apoptotic process. Apoptosis is a process of programmed cell death that includes a series of stereotyped morphological and biochemical events that lead to characteristic cell changes and death, including blebbing, cell shrinkage, nuclear fragmentation, chromatin condensation, chromosomal DNA fragmentation, and global mRNA decay. In some aspects, early stages of apoptosis can be indicated by activation of certain caspases, e.g., 2, 8, 9, and 10. In some aspects, middle to late stages of apoptosis are characterized by further loss of membrane integrity, chromatin condensation and DNA fragmentation, include biochemical events such as activation of caspases 3, 6, and 7.

In particular embodiments, the phenotype is negative expression of one or more factors associated with programmed cell death, for example pro-apoptotic factors known to initiate apoptosis, e.g., members of the death receptor pathway, activated members of the mitochondrial (intrinsic) pathway, such as Bcl-2 family members, e.g., Bax, Bad, and Bid, and caspases. In certain embodiments, the phenotype is the absence of an indicator, e.g., an Annexin V molecule or by TUNEL staining, that will preferentially bind to cells undergoing apoptosis when incubated with or contacted to a cell composition. In some embodiments, the phenotype is or includes the expression of one or more markers that are indicative of an apoptotic state in the cell. In some embodiments, the phenotype is lack of expression and/or activation of a caspase, such as caspase 3. In some aspects, activation of caspase-3 is indicative of an increase or revival of apoptosis. In certain embodiments, caspase activation can be detected by known methods. In some embodiments, an antibody that binds specifically to an activated caspase (i.e., binds specifically to the cleaved polypeptide) can be used to detect caspase activation. In particular embodiments, the phenotype is or includes active caspase 3-. In some embodiments, the marker of apoptosis is a reagent that detects a feature in a cell that is associated with apoptosis. In certain embodiments, the reagent is an annexin V molecule.

In some embodiments, the compositions containing the engineered cells for administration contain a certain number or amount of cells that exhibit phenotypes indicative of or consistent with cell health. In some of any embodiments, less than about 25%, 20%, 15%, 10%, 9%, 8%, 7%, 6%, 5%, 4%, 3%, 2% or 1% of the CAR-expressing T cells in the dose of engineered T cells express a marker of apoptosis, optionally Annexin V or active Caspase 3. In some of any embodiments, less than 5%, 4%, 3%, 2% or 1% of the CAR-expressing T cells in the dose of engineered T cells express Annexin V or active Caspase 3.

In some embodiments the cells administered are immune cells engineered to express the BCMA-binding recombinant receptor, e.g., CAR. In some embodiments the immune cells are T cells. In some embodiments, the administered cells are CD4+ T cells. In some embodiments the administered cells are CD8+ T cells. In some embodiments, the administered cells are a combination of CD4+ and CD8+ T cells, such as a combination of CD4+ CAR T cells and CD8+ CAR T cells, which in some aspects are within the same vessel or cell composition or suspension. In some examples the ratio of CD4+ cells to CD8+ cells (CD4:CD8) administered, such as ratio within the suspension or composition or vessel, is 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1. In some embodiments, the ratio is between 1:3 and 3:1 or is between at or about 1:4 to at or about 4:1, or between at or about 1:3 to at or about 3:1, or between at or about 1:2 to at or about 2:1, or any of such ratios, within a tolerated error rate. In some aspects, among subjects receiving the therapy and/or among subjects from whom samples are taken and processed to produce the cell compositions, the ratio of CD4+ CAR-T cells to CD8+ CAR-T cells or ratio of CD4+ to CD8+ cells is within a desired range, such as between at or about 1:4 to at or about 4:1, or between at or about 1:3 to at or about 3:1, or between at or about 1:2 to at or about 2:1, or is within such desired ratio for a given percentage of such subjects, such as for at least 65%, at least 70%, at least 75% or at least 80% or at least 85% or at least 90% or at least 95%, of such subjects.

In some embodiments, the cells, binding molecules, or recombinant receptors are administered as part of a combination treatment, such as simultaneously with or sequentially with, in any order, another therapeutic intervention, such as another antibody or engineered cell or receptor or agent, such as a cytotoxic or therapeutic agent.

The cells, binding molecules and/or recombinant receptors in some embodiments are co-administered with one or more additional therapeutic agents or in connection with another therapeutic intervention, either simultaneously or sequentially in any order. In some contexts, the cells are co-administered with another therapy sufficiently close in time such that the cell populations enhance the effect of one or more additional therapeutic agents, or vice versa. In some embodiments, the cells, binding molecules and/or recombinant receptors are administered prior to the one or more additional therapeutic agents. In some embodiments, the cells, binding molecules and/or recombinant receptors are administered after to the one or more additional therapeutic agents.

In some embodiments, the subject may receive a bridging therapy after leukapheresis and before lymphodepleting chemotherapy. A treating physician can determine if bridging therapy is necessary, for example for disease control, during manufacturing of the provided composition or cells. In some embodiments, bridging therapies do not include biological agents, such as antibodies (e.g., Daratumumab). In some embodiments, bridging therapies are discontinued prior to initiation of lymphodepletion. In some embodiments, bridging therapies are discontinued 1 day, 2 days 3 days, 4 days, 5 days, 7 days, 10 days, 14 days, 21 days, 28 days, 45 days, or 60 days before lymphodepletion.

Once the cells are administered to a mammal (e.g., a human), the biological activity of the engineered cell populations and/or antibodies in some aspects is measured by any of a number of known methods. Parameters to assess include specific binding of an engineered or natural T cell or other immune cell to antigen, in vivo, e.g., by imaging, or ex vivo, e.g., by ELISA or flow cytometry. In certain embodiments, the ability of the engineered cells to destroy target cells can be measured using any suitable method known in the art, such as cytotoxicity assays described in, for example, Kochenderfer et al., *J. Immunotherapy*, 32(7): 689-702 (2009), and Herman et al. *J. Immunological Methods*, 285 (1): 25-40 (2004). In certain embodiments, the biological activity of the cells also can be measured by assaying expression and/or secretion of certain cytokines, such as CD 107a, IFNγ, IL-2, and TNF. In some aspects the biological activity is measured by assessing clinical outcome, such as reduction in tumor burden or load.

In certain embodiments, engineered cells are modified in any number of ways, such that their therapeutic or prophylactic efficacy is increased. For example, the engineered CAR or TCR expressed by the population in some embodiments are conjugated either directly or indirectly through a linker to a targeting moiety. The practice of conjugating compounds, e.g., the CAR or TCR, to targeting moieties is known in the art. See, for instance, Wadwa et al., *J. Drug Targeting*, 3(2):111 (1995), and U.S. Pat. No. 5,087,616.

B. Combination Therapy

Also provided are methods of combination therapy that includes administering and uses, such as therapeutic and prophylactic uses, of the BCMA-binding recombinant receptors (e.g., CARs), engineered cells expressing the recombinant receptors (e.g., CARs), plurality of engineered cells expressing the receptors, and/or compositions comprising the same.

In some embodiments, the BCMA-binding recombinant receptor (e.g., chimeric antigen receptor) and/or engineered cells expressing said molecules (e.g., recombinant receptor) described herein are administered as part of a combination treatment or combination therapy, such as simultaneously with, sequentially with or intermittently with, in any order, one or more additional therapeutic intervention. In some embodiments, the one or more additional therapeutic intervention includes, for example, an antibody, an engineered cell, a receptor and/or an agent, such as a cell expressing a recombinant receptor, and/or cytotoxic or therapeutic agent, e.g., a chemotherapeutic agent. In some embodiments, the combination therapy includes administration of one or more additional agents, therapies and/or treatments, e.g., any of the additional agents, therapy and/or treatments described herein. In some embodiments, the combination therapy includes administration of one or more additional agents for treatment or therapy, such as an immunomodulatory agent, immune checkpoint inhibitor, adenosine pathway or adenosine receptor antagonist or agonist and kinase inhibitors. In some embodiments, the combination treatment or combination therapy includes an additional treatment, such as a surgical treatment, transplant, and/or radiation therapy. Also provided are methods of combination treatment or combination therapy that includes BCMA-binding recombinant receptors (e.g., CARs), cells and/or compositions described herein and one or more additional therapeutic interventions.

In some embodiments, the additional agent for combination treatment or combination therapy enhances, boosts and/or promotes the efficacy and/or safety of the therapeutic effect of binding molecules, recombinant receptors, cells and/or compositions. In some embodiments, the additional agent enhances or improves the efficacy, survival or persistence of the administered cells, e.g., cells expressing the binding molecule or a recombinant receptor. In some embodiments, the additional agent is selected from among a protein phosphatase inhibitor, a kinase inhibitor, a cytokine, an immunomodulator, or an agent that decreases the level or activity of a regulatory T (Treg) cell. In some embodiments, the additional agent enhances safety, by virtue of reducing or ameliorating adverse effects of the administered binding molecules, recombinant receptors, cells and/or compositions. In some embodiments, the additional agent can treat the same disease, condition or a comorbidity. In some embodiments, the additional agent can ameliorate, reduce or eliminate one or more toxicities, adverse effects or side effects that are associated with administration of the recombinant receptors, cells and/or compositions, e.g., CAR-expressing cells.

In some embodiments, pain management medication such as acetaminophen, or antihistamine, such as diphenhydramine can be administered prior to, during or after administration of the recombinant receptor, cell or composition provided herein, to ameliorate or reduce or eliminate minor side effects associated with treatment. In some examples, red blood cell and platelet transfusions, and/or colony-stimulating factors can be administered reduce or eliminate one or more toxicities, adverse effects or side effects that are associated with administration of the recombinant receptors, cells and/or compositions, e.g., CAR-expressing cells. In some embodiments, prophylactic or empiric anti-infective agents (e.g., trimethoprim/sulfamethoxazole for pneumocystis pneumonia [PCP] prophylaxis, broad spectrum antibiotics, antifungals, or antiviral agents for febrile neutropenia) can be administered to treat side-effects resulting from treatment. In some examples, when necessary, prophylaxis may be provided to treat lymphopenia and/or neutropenia occurring as a result of treatment.

In some embodiments, the additional therapy, treatment or agent includes chemotherapy, radiation therapy, surgery, transplantation, adoptive cell therapy, antibodies, cytotoxic agents, chemotherapeutic agents, cytokines, growth inhibitory agents, anti-hormonal agents, kinase inhibitors, anti-angiogenic agents, cardioprotectants, immunostimulatory agents, immunosuppressive agents, immune checkpoint inhibitors, antibiotics, angiogenesis inhibitors, metabolic modulators or other therapeutic agents or any combination thereof. In some embodiments, the additional agent is a protein, a peptide, a nucleic acid, a small molecule agent, a cell, a toxin, a lipid, a carbohydrate or combinations thereof, or any other type of therapeutic agent, e.g. radiation. In some embodiments, the additional therapy, agent or treatment includes surgery, chemotherapy, radiation therapy, transplantation, administration of cells expressing a recombinant receptor, e.g., CAR, kinase inhibitor, immune checkpoint inhibitor, mTOR pathway inhibitor, immunosuppressive agents, immunomodulators, antibodies, immunoablative agents, antibodies and/or antigen binding fragments thereof, antibody conjugates, other antibody therapies, cytotoxins, steroids, cytokines, peptide vaccines, hormone therapy, antimetabolites, metabolic modulators, drugs that inhibit either the calcium dependent phosphatase calcineurin or the p70S6 kinase FK506) or inhibit the p70S6 kinase, alkylating agents, anthracyclines, vinca alkaloids, proteasome inhibitors, GITR agonists, protein tyrosine phosphatase inhibitors, protein kinase inhibitors, an oncolytic virus, and/or other types of immunotherapy. In some embodiments, the additional agent or treatment is bone marrow transplantation, T cell ablative therapy using chemotherapy agents such as, fludarabine, external-beam radiation therapy (XRT), cyclophosphamide, and/or antibody therapy.

In some embodiments, the cells, BCMA-binding recombinant receptors and/or compositions, e.g., CAR-expressing cells, are administered in combination with other engineered cells, e.g., other CAR-expressing cells. In some embodiments, the additional agent is a kinase inhibitor, e.g., an inhibitor of Bruton's tyrosine kinase (Btk), e.g., ibrutinib. In some embodiments, the additional agent is an adenosine pathway or adenosine receptor antagonist or agonist. In some embodiments, the additional agent is an immunomodulator such as thalidomide or a thalidomide derivative (e.g., lenalidomide). In some embodiments, the additional agent is a gamma secretase inhibitor, such as a gamma secretase inhibitor that inhibits or reduces intramembrane cleavage of a target of a gamma secretase, e.g. BCMA, on a cell (such as a tumor/cancer cell). In some embodiments, the additional therapy, agent or treatment is a cytotoxic or chemotherapy agent, a biologic therapy (e.g., antibody, e.g., monoclonal antibody, or cellular therapy), or an inhibitor (e.g., kinase inhibitor).

In some embodiments, the additional agent is a chemotherapeutic agent. Exemplary chemotherapeutic agents include an anthracycline (e.g., doxorubicin, such as liposomal doxorubicin); a vinca alkaloid (e.g., vinblastine, vincristine, vindesine, vinorelbine); an alkylating agent (e.g., cyclophosphamide, decarbazine, melphalan, ifosfamide, temozolomide); an immune cell antibody (e.g., alemtuzumab, gemtuzumab, rituximab, tositumomab); an antimetabolite (including, e.g., folic acid antagonists, pyrimidine analogs, purine analogs and adenosine deaminase inhibitors such as fludarabine); a TNFR glucocorticoid induced TNFR related protein (GITR) agonist; a proteasome inhibitor (e.g., aclacinomycin A, gliotoxin or bortezomib); an immunomodulatory such as thalidomide or a thalidomide derivative (e.g., lenalidomide).

In some embodiments, the additional therapy or treatment is cell therapy, e.g., adoptive cell therapy. In some embodiments, the additional therapy includes administration of engineered cells, e.g., additional CAR-expressing cell. In some embodiments, the additional engineered cell is a CAR-expressing cell that expresses the same or different recombinant receptor as the engineered cells provided herein, e.g., anti-BCMA CAR-expressing cells. In some embodiments, the recombinant receptor, e.g., CAR, expressed on the additional engineered cell, recognizes a different antigen and/or epitope. In some embodiments, the recombinant receptor, e.g., CAR, expressed on the additional engineered cell, recognizes a different epitope of the same antigen as the recombinant receptors described herein, e.g., BCMA. In some embodiments, the recombinant receptor, e.g., CAR, expressed on the additional engineered cell, recognizes a different antigen, e.g., a different tumor antigen or combination of antigens. For example, in some embodiments, the recombinant receptor, e.g., CAR, expressed on the additional engineered cell, targets cancer cells that express early lineage markers, e.g., cancer stem cells, while other CAR-expressing cells target cancer cells that express later lineage markers. In such embodiments, the additional engineered cell is administered prior to, concurrently with, or after administration (e.g., infusion) of the CAR-expressing cells described herein. In some embodiments, the additional engineered cell expresses allogeneic CAR.

In some embodiments, the configurations of one or more of the CAR molecules comprise a primary intracellular signaling domain and two or more, e.g., 2, 3, 4, or 5 or more, costimulatory signaling domains. In some embodiments, the one or more of the CAR molecules may have the same or a different primary intracellular signaling domain, the same or different costimulatory signaling domains, or the same number or a different number of costimulatory signaling domains. In some embodiments, the one or more of the CAR molecules can be configured as a split CAR, in which one of the CAR molecules comprises an antigen binding domain and a costimulatory domain (e.g., 4-1BB), while the other CAR molecule comprises an antigen binding domain and a primary intracellular signaling domain (e.g., CD3 zeta).

In some embodiments, the additional agent is any of the cells engineered to express one or more of the anti-BCMA binding molecules and/or cells engineered to express additional binding molecules, e.g., recombinant receptors, e.g., CAR, that target a different antigen. In some embodiments, the additional agent includes any of the cells or plurality of cells described herein, e.g., in Section I.C. In some embodiments, the additional agent is a cell engineered to express a recombinant receptor, e.g., CAR, targeting a different epitope and/or antigen, e.g., a different antigen associated with a disease or condition. In some embodiments, the additional agent is a cell engineered to express a recombinant receptor, e.g., CAR, targeting a second or additional antigen expressed in multiple myeloma, e.g., CD38, CD138, CS-1, BAFF-R, TACI and/or FcRH5.

In some embodiments, the additional agent is an immunomodulatory agent. In some embodiments, the combination therapy includes an immunomodulatory agent that can stimulate, amplify and/or otherwise enhance an anti-tumor immune response, e.g. anti-tumor immune response from the administered engineered cells, such as by inhibiting immunosuppressive signaling or enhancing immunostimulant signaling. In some embodiments, the immunomodulatory agent is a peptide, protein or is a small molecule. In some embodiments, the protein can be a fusion protein or a recombinant protein. In some embodiments, the immunomodulatory agent binds to an immunologic target, such as a cell surface receptor expressed on immune cells, such a T cells, B cells or antigen-presenting cells. For example, in some embodiments, the immunomodulatory agent is an antibody or antigen-binding antibody fragment, a fusion protein, a small molecule or a polypeptide. In some embodiments, the recombinant receptors, cells and/or compositions are administered in combination with an additional agent that is an antibody or an antigen-binding fragment thereof, such as a monoclonal antibody.

In some embodiments, the immunomodulatory agent blocks, inhibits or counteracts a component of the immune checkpoint pathway. The immune system has multiple inhibitory pathways that are involved in maintaining self-tolerance and for modulating immune responses. Tumors can use certain immune-checkpoint pathways as a major mechanism of immune resistance, particularly against T cells that are specific for tumor antigens (Pardoll (2012) Nature Reviews Cancer 12:252-264), e.g., engineered cells such as CAR-expressing cells. Because many such immune checkpoints are initiated by ligand-receptor interactions, they can be readily blocked by antibodies against the ligands and/or their receptors.

Therefore, therapy with antagonistic molecules blocking an immune checkpoint pathway, such as small molecules, nucleic acid inhibitors (e.g., RNAi) or antibody molecules, are becoming promising avenues of immunotherapy for cancer and other diseases. In contrast to the majority of anti-cancer agents, checkpoint inhibitors do not necessarily target tumor cells directly, but rather target lymphocyte receptors or their ligands in order to enhance the endogenous antitumor activity of the immune system.

As used herein, the term "immune checkpoint inhibitor" refers to molecules that totally or partially reduce, inhibit, interfere with or modulate one or more checkpoint proteins. Checkpoint proteins regulate T-cell activation or function. These proteins are responsible for co-stimulatory or inhibitory interactions of T-cell responses. Immune checkpoint proteins regulate and maintain self-tolerance and the duration and amplitude of physiological immune responses. In some embodiments, the subject can be administered an additional agent that can enhance or boost the immune response, e.g., immune response effected by the BCMA-binding recombinant receptors, cells and/or compositions provided herein, against a disease or condition, e.g., a cancer, such as any described herein.

Immune checkpoint inhibitors include any agent that blocks or inhibits in a statistically significant manner, the inhibitory pathways of the immune system. Such inhibitors may include small molecule inhibitors or may include antibodies, or antigen binding fragments thereof, that bind to and block or inhibit immune checkpoint receptors, ligands and/or receptor-ligand interaction. In some embodiments, modulation, enhancement and/or stimulation of particular receptors can overcome immune checkpoint pathway components. Illustrative immune checkpoint molecules that may be targeted for blocking, inhibition, modulation, enhancement and/or stimulation include, but are not limited to, PD-1 (CD279), PD-L1 (CD274, B7-H1), PDL2 (CD273, B7-DC), CTLA-4, LAG-3 (CD223), TIM-3, 4-1BB (CD137), 4-1BBL (CD137L), GITR (TNFRSF18, AITR), CD40, OX40 (CD134, TNFRSF4), CXCR2, tumor associated antigens (TAA), B7-H3, B7-H4, BTLA, HVEM, GAL9, B7H3, B7H4, VISTA, KIR, 2B4 (belongs to the CD2 family of molecules and is expressed on all NK, γδ, and memory CD8+(αβ) T cells), CD160 (also referred to as BY55), CGEN-15049, CEACAM (e.g., CEACAM-1, CEACAM-3 and/or CEACAM-5), TIGIT, LAIR1, CD160, 2B4, CD80, CD86, B7-H3 (CD276), B7-H4 (VTCN1), HVEM (TNFRSF14 or CD270), KIR, A2aR, WIC class I, MHC class II, GAL9, adenosine, and a transforming growth factor receptor (TGFR; e.g., TGFR beta). Immune checkpoint inhibitors include antibodies, or antigen binding fragments thereof, or other binding proteins, that bind to and block or inhibit and/or enhance or stimulate the activity of one or more of any of the said molecules.

Exemplary immune checkpoint inhibitors include Tremelimumab (CTLA-4 blocking antibody, also known as ticilimumab, CP-675,206), anti-OX40, PD-L1 monoclonal antibody (Anti-B7-H1; MEDI4736), MK-3475 (PD-1 blocker), nivolumab (anti-PD-1 antibody), CT-011 (anti-PD-1 antibody), BY55 monoclonal antibody, AMP224 (anti-PD-L1 antibody), BMS-936559 (anti-PD-L1 antibody), MPLDL3280A (anti-PD-L1 antibody), MSB0010718C (anti-PD-L1 antibody) and ipilimumab (anti-CTLA-4 antibody, also known as Yervoy®, MDX-010 and MDX-101). Exemplary immunomodulatory antibodies include, but are not limited to, Daclizumab (Zenapax), Bevacizumab (Avastin®), Basiliximab, Ipilimumab, Nivolumab, pembrolizumab, MPDL3280A, Pidilizumab (CT-011), MK-3475, BMS-936559, MPDL3280A (Atezolizumab), tremelimumab, IMP321, BMS-986016, LAG525, urelumab, PF-05082566, TRX518, MK-4166, dacetuzumab (SGN-40), lucatumumab (HCD122), SEA-CD40, CP-870, CP-893, MEDI6469, MEDI6383, MOXR0916, AMP-224, MSB0010718C (Avelumab), MEDI4736, PDR001, rHIgM12B7, Ulocuplumab, BKT140, Varlilumab (CDX-1127), ARGX-110, MGA271, lirilumab (BMS-986015, IPH2101), IPH2201, ARGX-115, Emactuzumab, CC-90002 and 1VINRP1685A or an antibody-binding fragment thereof. Other exemplary immunomodulators include, e.g., afutuzumab (available from Roche®); pegfilgrastim (Neulasta®); lenalidomide (CC-5013, Revlimid®); thalidomide (Thalomid®), actimid (CC4047); and IRX-2 (mixture of human cytokines including interleukin 1, interleukin 2, and interferon gamma, CAS 951209-71-5, available from IRX Therapeutics).

Programmed cell death 1 (PD-1) is an immune checkpoint protein that is expressed in B cells, NK cells, and T cells (Shinohara et al., 1995, Genomics 23:704-6; Blank et al., 2007, Cancer Immunol Immunother 56:739-45; Finger et al., 1997, Gene 197:177-87; Pardoll (2012) Nature Reviews Cancer 12:252-264). The major role of PD-1 is to limit the activity of T cells in peripheral tissues during inflammation in response to infection, as well as to limit autoimmunity. PD-1 expression is induced in activated T cells and binding of PD-1 to one of its endogenous ligands acts to inhibit T-cell activation by inhibiting stimulatory kinases. PD-1 also acts to inhibit the TCR "stop signal". PD-1 is highly expressed on Treg cells and may increase their proliferation in the presence of ligand (Pardoll (2012) Nature Reviews Cancer 12:252-264). Anti-PD 1 antibodies have been used for treatment of melanoma, non-small-cell lung cancer, bladder cancer, prostate cancer, colorectal cancer, head and neck cancer, triple-negative breast cancer, leukemia, lymphoma and renal cell cancer (Topalian et al., 2012, N Engl J Med 366:2443-54; Lipson et al., 2013, Clin Cancer Res 19:462-8; Berger et al., 2008, Clin Cancer Res 14:3044-51; Gildener-Leapman et al., 2013, Oral Oncol 49:1089-96; Menzies & Long, 2013, Ther Adv Med Oncol 5:278-85). Exemplary anti-PD-1 antibodies include nivolumab (Opdivo by BMS), pembrolizumab (Keytruda by Merck), pidilizumab (CT-011 by Cure Tech), lambrolizumab (MK-3475 by Merck), and AMP-224 (Merck), nivolumab (also referred to as Opdivo, BMS-936558 or MDX1106; Bristol-Myers Squibb) is a fully human IgG4 monoclonal antibody which specifically blocks PD-1. Nivolumab (clone 5C4) and other human monoclonal antibodies that specifically bind to PD-1 are described in U.S. Pat. No. 8,008,449 and WO2006/121168. Pidilizumab (CT-011; Cure Tech) is a humanized IgG1k monoclonal antibody that binds to PD-1. Pidilizumab and other humanized anti-PD-1 monoclonal antibodies are described in WO2009/101611. Pembrolizumab (formerly known as lambrolizumab, and also referred to as Keytruda, MK03475; Merck) is a humanized IgG4 monoclonal antibody that binds to PD-1. Pembrolizumab and other humanized anti-PD-1 antibodies are described in U.S. Pat. No. 8,354,509 and WO2009/114335. Other anti-PD-1 antibodies include AMP 514 (Amplimmune), among others, e.g., anti-PD-1 antibodies described in U.S. Pat. No. 8,609,089, US 2010028330, US 20120114649 and/or US 20150210769. AMP-224 (B7-DCIg; Amplimmune; e.g., described in WO2010/027827 and WO2011/066342), is a PD-L2 Fc fusion soluble receptor that blocks the interaction between PD-1 and B7-H1.

PD-L1 (also known as CD274 and B7-H1) and PD-L2 (also known as CD273 and B7-DC) are ligands for PD-1, found on activated T cells, B cells, myeloid cells, macrophages, and some types of tumor cells. Anti-tumor therapies have focused on anti-PD-L1 antibodies. The complex of PD-1 and PD-L1 inhibits proliferation of CD8+ T cells and reduces the immune response (Topalian et al., 2012, N Engl J Med 366:2443-54; Brahmer et al., 2012, N Eng J Med 366:2455-65). Anti-PD-L1 antibodies have been used for treatment of non-small cell lung cancer, melanoma, colorectal cancer, renal-cell cancer, pancreatic cancer, gastric cancer, ovarian cancer, breast cancer, and hematologic malignancies (Brahmer et al., 2012, N Eng J Med 366:2455-65; Ott et al., 2013, Clin Cancer Res 19:5300-9; Radvanyi et al., 2013, Clin Cancer Res 19:5541; Menzies & Long, 2013, Ther Adv Med Oncol 5:278-85; Berger et al., 2008, Clin Cancer Res 14:13044-51). Exemplary anti-PD-L1 antibodies include MDX-1105 (Medarex), MEDI4736 (Medimmune) MPDL3280A (Genentech), BMS-935559 (Bristol-Myers Squibb) and MSB0010718C. MEDI4736 (Medimmune) is a human monoclonal antibody that binds to PD-L1, and inhibits interaction of the ligand with PD-1. MDPL3280A (Genentech/Roche) is a human Fc optimized IgG1 monoclonal antibody that binds to PD-L1. MDPL3280A and other human monoclonal antibodies to PD-L1 are described in U.S. Pat. No. 7,943,743 and U.S. Publication No. 20120039906. Other anti-PD-L1 binding agents include YW243.55.570 (see WO2010/077634) and MDX-1105 (also referred to as BMS-936559, and, e.g., anti-PD-L1 binding agents described in WO2007/005874).

Cytotoxic T-lymphocyte-associated antigen (CTLA-4), also known as CD152, is a co-inhibitory molecule that functions to regulate T-cell activation. CTLA-4 is a member of the immunoglobulin superfamily that is expressed exclusively on T-cells. CTLA-4 acts to inhibit T-cell activation and is reported to inhibit helper T-cell activity and enhance regulatory T-cell immunosuppressive activity. Although the precise mechanism of action of CTLA-4 remains under investigation, it has been suggested that it inhibits T cell activation by outcompeting CD28 in binding to CD80 and CD86, as well as actively delivering inhibitor signals to the T cell (Pardoll (2012) Nature Reviews Cancer 12:252-264). Anti-CTLA-4 antibodies have been used in clinical trials for the treatment of melanoma, prostate cancer, small cell lung cancer, non-small cell lung cancer (Robert & Ghiringhelli, 2009, Oncologist 14:848-61; Ott et al., 2013, Clin Cancer Res 19:5300; Weber, 2007, Oncologist 12:864-72; Wada et al., 2013, J Transl Med 11:89). A significant feature of anti-CTLA-4 is the kinetics of anti-tumor effect, with a lag period of up to 6 months after initial treatment required for physiologic response. In some cases, tumors may actually increase in size after treatment initiation, before a reduction is seen (Pardoll (2012) Nature Reviews Cancer 12:252-264). Exemplary anti-CTLA-4 antibodies include ipilimumab (Bristol-Myers Squibb) and tremelimumab (Pfizer). Ipilimumab has recently received FDA approval for treatment of metastatic melanoma (Wada et al., 2013, J Transl Med 11:89).

Lymphocyte activation gene-3 (LAG-3), also known as CD223, is another immune checkpoint protein. LAG-3 has been associated with the inhibition of lymphocyte activity and in some cases the induction of lymphocyte anergy. LAG-3 is expressed on various cells in the immune system including B cells, NK cells, and dendritic cells. LAG-3 is a natural ligand for the MHC class II receptor, which is substantially expressed on melanoma-infiltrating T cells including those endowed with potent immune-suppressive activity. Exemplary anti-LAG-3 antibodies include BMS-986016 (Bristol-Myers Squib), which is a monoclonal antibody that targets LAG-3. IMP701 (Immutep) is an antagonist LAG-3 antibody and IMP731 (Immutep and GlaxoSmithKline) is a depleting LAG-3 antibody. Other LAG-3 inhibitors include IMP321 (Immutep), which is a recombinant fusion protein of a soluble portion of LAG-3 and Ig that binds to MHC class II molecules and activates antigen presenting cells (APC). Other antibodies are described, e.g., in WO2010/019570 and US 2015/0259420

T-cell immunoglobulin domain and mucin domain-3 (TIM-3), initially identified on activated Th1 cells, has been shown to be a negative regulator of the immune response. Blockade of TIM-3 promotes T-cell mediated anti-tumor immunity and has anti-tumor activity in a range of mouse tumor models. Combinations of TIM-3 blockade with other immunotherapeutic agents such as TSR-042, anti-CD137 antibodies and others, can be additive or synergistic in increasing anti-tumor effects. TIM-3 expression has been associated with a number of different tumor types including melanoma, NSCLC and renal cancer, and additionally, expression of intratumoral TIM-3 has been shown to correlate with poor prognosis across a range of tumor types including NSCLC, cervical, and gastric cancers. Blockade of TIM-3 is also of interest in promoting increased immunity to a number of chronic viral diseases. TIM-3 has also been shown to interact with a number of ligands including galectin-9, phosphatidylserine and HMGB1, although which of these, if any, are relevant in regulation of anti-tumor responses is not clear at present. In some embodiments, antibodies, antibody fragments, small molecules, or peptide inhibitors that target TIM-3 can bind to the IgV domain of TIM-3 to inhibit interaction with its ligands. Exemplary antibodies and peptides that inhibit TIM-3 are described in US 2015/0218274, WO2013/006490 and US 2010/0247521. Other anti-TIM-3 antibodies include humanized versions of RMT3-23 (Ngiow et al., 2011, Cancer Res, 71:3540-3551), and clone 8B.2C12 (Monney et al., 2002, Nature, 415:536-541). Bi-specific antibodies that inhibit TIM-3 and PD-1 are described in US 2013/0156774.

In some embodiments, the additional agent is a CEACAM inhibitor (e.g., CEACAM-1, CEACAM-3, and/or CEACAM-5 inhibitor). In some embodiments, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In some embodiments, the anti-CEACAM antibody binds to CEACAM-5 as described in, e.g., Zheng et al. PLoS One. (2011) 6(6): e21146), or cross reacts with CEACAM-1 and CEACAM-5 as described in, e.g., WO 2013/054331 and US 2014/0271618.

4-1BB, also known as CD137, is transmembrane glycoprotein belonging to the TNFR superfamily. 4-1BB receptors are present on activated T cells and B cells and monocytes. An exemplary anti-4-1BB antibody is urelumab (BMS-663513), which has potential immunostimulatory and antineoplastic activities.

Tumor necrosis factor receptor superfamily, member 4 (TNFRSF4), also known as OX40 and CD134, is another member of the TNFR superfamily. OX40 is not constitutively expressed on resting naïve T cells and acts as a secondary co-stimulatory immune checkpoint molecule. Exemplary anti-OX40 antibodies are MEDI6469 and MOXR0916 (RG7888, Genentech).

In some embodiments, the additional agent includes a molecule that decreases the regulatory T cell (Treg) population. Methods that decrease the number of (e.g., deplete) Treg cells are known in the art and include, e.g., CD25 depletion, cyclophosphamide administration, and modulating Glucocorticoid-induced TNFR family related gene (GITR) function. GITR is a member of the TNFR superfamily that is upregulated on activated T cells, which enhances the immune system. Reducing the number of Treg cells in a subject prior to apheresis or prior to administration of engineered cells, e.g., CAR-expressing cells, can reduce the number of unwanted immune cells (e.g., Tregs) in the tumor microenvironment and reduces the subject's risk of relapse. In some embodiments, the additional agent includes a molecule targeting GITR and/or modulating GITR functions, such as a GITR agonist and/or a GITR antibody that depletes regulatory T cells (Tregs). In some embodiments, the additional agent includes cyclophosphamide. In some embodiments, the GITR binding molecule and/or molecule modulating GITR function (e.g., GITR agonist and/or Treg depleting GITR antibodies) is administered prior to the engineered cells, e.g., CAR-expressing cells. For example, in some embodiments, the GITR agonist can be administered prior to apheresis of the cells. In some embodiments, cyclophosphamide is administered to the subject prior to administration (e.g., infusion or re-infusion) of the engineered cells, e.g., CAR-expressing cells or prior to apheresis of the cells. In some embodiments, cyclophosphamide and an anti-GITR antibody are administered to the subject prior to administration (e.g., infusion or re-infusion) of the engineered cells, e.g., CAR-expressing cells or prior to apheresis of the cells.

In some embodiments, the additional agent is a GITR agonist. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No. 090505B 1, U.S. Pat. No. 8,586,023, PCT Publication Nos.: WO 2010/003118 and 2011/090754, or an anti-GITR antibody described, e.g., in U.S. Pat. No. 7,025,962, European Patent No. 1947183B 1, U.S. Pat. Nos. 7,812,135, 8,388, 967, 8,591,886, European Patent No. EP 1866339, PCT Publication No. WO 2011/028683, PCT Publication No. WO 2013/039954, PCT Publication No. WO2005/007190, PCT Publication No. WO 2007/133822, PCT Publication No. WO2005/055808, PCT Publication No. WO 99/40196, PCT Publication No. WO 2001/03720, PCT Publication No. WO99/20758, PCT Publication No. WO2006/083289, PCT Publication No. WO 2005/115451, U.S. Pat. No. 7,618,632, and PCT Publication No. WO 2011/051726. An exemplary anti-GITR antibody is TRX518.

In some embodiments, the additional agent enhances tumor infiltration or transmigration of the administered cells, e.g., CAR-expressing cells. For example, in some embodiments, the additional agent stimulates CD40, such as CD40L, e.g., recombinant human CD40L. Cluster of differentiation 40 (CD40) is also a member of the TNFR superfamily. CD40 is a costimulatory protein found on antigen-presenting cells and mediates a broad variety of immune and inflammatory responses. CD40 is also expressed on some malignancies, where it promotes proliferation. Exemplary anti-CD40 antibodies are dacetuzumab (SGN-40), lucatumumab (Novartis, antagonist), SEA-CD40 (Seattle Genetics), and CP-870,893. In some embodiments, the additional agent that enhances tumor infiltration includes tyrosine kinase inhibitor sunitnib, heparanase, and/or chemokine receptors such as CCR2, CCR4, and CCR7.

In some embodiments, the additional agent includes thalidomide drugs or analogs thereof and/or derivatives thereof, such as lenalidomide, pomalidomide or apremilast. See, e.g., Bertilaccio et al., Blood (2013) 122:4171, Otahal et al., Oncoimmunology (2016) 5(4):e1115940; Fecteau et al., Blood (2014) 124(10):1637-1644 and Kuramitsu et al., Cancer Gene Therapy (2015) 22:487-495). Lenalidomide ((RS)-3-(4-Amino-1-oxo-1,3-dihydro-2H-isoindol-2-yl)piperidine-2,6-dione; also known as Revlimid) is a synthetic derivative of thalidomide, and has multiple immunomodulatory effects, including enforcement of immune synapse formation between T cell and antigen presenting cells (APCs). For example, in some cases, lenalidomide modulates T cell responses and results in increased interleukin (IL)-2 production in CD4+ and CD8+ T cells, induces the shift of T helper (Th) responses from Th2 to Th1, inhibits expansion of regulatory subset of T cells (Tregs), and improves functioning of immunological synapses in follicular lymphoma and chronic lymphocytic leukemia (CLL) (Otahal et al., Oncoimmunology (2016) 5(4):e1115940). Lenalidomide also has direct tumoricidal activity in patients with multiple myeloma (MM) and directly and indirectly modulates survival of CLL tumor cells by affecting supportive cells, such as nurse-like cells found in the microenvironment of lymphoid tissues. Lenalidomide also can enhance T-cell proliferation and interferon-γ production in response to activation of T cells via CD3 ligation or dendritic cell-mediated activation. Lenalidomide can also induce malignant B cells to express higher levels of immunostimulatory molecules such as CD80, CD86, HLA-DR, CD95, and CD40 (Fecteau et al., Blood (2014) 124(10): 1637-1644). In some embodiments, lenalidomide is administered at a dosage of from about 1 mg to about 20 mg daily, e.g., from about 1 mg to about 10 mg, from about 2.5 mg to about 7.5 mg, from about 5 mg to about 15 mg, such as about 5 mg, 10 mg, 15 mg or 20 mg daily. In some embodiments, lenalidomide is administered at a dose of from about 10 μg/kg to 5 mg/kg, e.g., about 100 μg/kg to about 2 mg/kg, about 200 μg/kg to about 1 mg/kg, about 400 μg/kg to about 600 μg/kg, such as about 500 μg/kg. In some embodiments, rituximab is administered at a dosage of about 350-550 mg/m$^2$ (e.g., 350-375, 375-400, 400-425, 425-450, 450-475, or 475-500 mg/m$^2$), e.g., intravenously. In some embodiments, lenalidomide is administered at a low dose.

In some embodiments, the additional agent is a B-cell inhibitor. In some embodiments, the additional agent is one or more B-cell inhibitors selected from among inhibitors of CD10, CD19, CD20, CD22, CD34, CD123, CD79a, CD79b, CD179b, FLT-3, or ROR1, or a combination thereof. In some embodiments, the B-cell inhibitor is an antibody (e.g., a mono- or bispecific antibody) or an antigen binding fragment thereof. In some embodiments, the additional agent is an engineered cell expressing recombinant receptors that target B-cell targets, e.g., CD10, CD19, CD20, CD22, CD34, CD123, CD79a, CD79b, CD179b, FLT-3, or ROR1.

In some embodiments, the additional agent is a CD20 inhibitor, e.g., an anti-CD20 antibody (e.g., an anti-CD20 mono- or bi-specific antibody) or a fragment thereof. Exemplary anti-CD20 antibodies include but are not limited to rituximab, ofatumumab, ocrelizumab (also known as GA101 or R05072759), veltuzumab, obinutuzumab, TRU-015 (Trubion Pharmaceuticals), ocaratuzumab (also known as AME-133v or ocaratuzumab), and Pro131921 (Genentech). See, e.g., Lim et al. Haematologica. (2010) 95(1):135-43. In some embodiments, the anti-CD20 antibody comprises rituximab. Rituximab is a chimeric mouse/human monoclonal antibody IgG1 kappa that binds to CD20 and causes cytolysis of a CD20 expressing cell. In some embodiments, the additional agent includes rituximab. In some embodiments, the CD20 inhibitor is a small molecule.

In some embodiments, the additional agent is a CD22 inhibitor, e.g., an anti-CD22 antibody (e.g., an anti-CD22 mono- or bi-specific antibody) or a fragment thereof. Exemplary anti-CD22 antibodies include epratuzumab and RFB4. In some embodiments, the CD22 inhibitor is a small molecule. In some embodiments, the antibody is a monospecific antibody, optionally conjugated to a second agent such as a chemotherapeutic agent. For instance, in some embodiments, the antibody is an anti-CD22 monoclonal antibody-MMAE conjugate (e.g., DCDT2980S). In some embodiments, the antibody is an scFv of an anti-CD22 antibody, e.g., an scFv of antibody RFB4. In some embodiments, the scFv is fused to all of or a fragment of *Pseudomonas* exotoxin-A (e.g., BL22). In some embodiments, the scFv is fused to all of or a fragment of (e.g., a 38 kDa fragment of) *Pseudomonas* exotoxin-A (e.g., moxetumomab pasudotox). In some embodiments, the anti-CD22 antibody is an anti-CD19/CD22 bispecific antibody, optionally conjugated to a toxin. For instance, in some embodiments, the anti-CD22 antibody comprises an anti-CD19/CD22 bispecific portion, (e.g., two scFv ligands, recognizing human CD19 and CD22) optionally linked to all of or a portion of diphtheria toxin (DT), e.g., first 389 amino acids of diphtheria toxin (DT), DT 390, e.g., a ligand-directed toxin such as DT2219ARL). In some embodiments, the bispecific portion (e.g., anti-CD 19/anti-CD22) is linked to a toxin such as deglycosylated ricin A chain (e.g., Combotox).

In some embodiments, the immunomodulatory agent is a cytokine. In some embodiments, the immunomodulatory agent is a cytokine or is an agent that induces increased expression of a cytokine in the tumor microenvironment. Cytokines have important functions related to T cell expansion, differentiation, survival, and homeostasis. Cytokines that can be administered to the subject receiving the BCMA-binding recombinant receptors, cells and/or compositions provided herein include one or more of IL-2, IL-4, IL-7, IL-9, IL-15, IL-18, and IL-21. In some embodiments, the cytokine administered is IL-7, IL-15, or IL-21, or a combination thereof. In some embodiments, administration of the cytokine to the subject that has sub-optimal response to the administration of the engineered cells, e.g., CAR-expressing cells improves efficacy and/or anti-tumor activity of the administered cells, e.g., CAR-expressing cells.

By "cytokine" is meant a generic term for proteins released by one cell population that act on another cell as intercellular mediators. Examples of such cytokines are lymphokines, monokines, and traditional polypeptide hormones. Included among the cytokines are growth hormones such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-alpha and -beta; mullerian-inhibiting substance; mouse gonadotropin-associated peptide; inhibin; activin; vascular endothelial growth factor; integrin; thrombopoietin (TPO); nerve growth factors such as NGF-beta; platelet-growth factor; transforming growth factors (TGFs) such as TGF-alpha and TGF-beta; insulin-like growth factor-I and -II; erythropoietin (EPO); osteoinductive factors; interferons such as interferon-alpha, beta, and -gamma; colony stimulating factors (CSFs) such as macrophage-CSF (M-CSF); granulocyte-macrophage-CSF (GM-CSF); and granulocyte-CSF (G-CSF); interleukins (ILs) such as IL-1, IL-1alpha, IL-2, IL-3, IL-4, IL-5, IL-6, IL-7, IL-8, IL-9, IL-10, IL-11, IL-12; IL-15, a tumor necrosis factor such as TNF-alpha or TNF-beta; and other polypeptide factors including LIF and kit ligand (KL). As used herein, the term cytokine includes proteins from natural sources or from recombinant cell culture, and biologically active equivalents of the native sequence cytokines. For example, the immunomodulatory agent is a cytokine and the cytokine is IL-4, TNF-α, GM-CSF or IL-2.

In some embodiments, the additional agent includes an interleukin-15 (IL-15) polypeptide, an interleukin-15 receptor alpha (IL-15Ra) polypeptide, or combination thereof, e.g., hetIL-15 (Admune Therapeutics, LLC). hetIL-15 is a heterodimeric non-covalent complex of IL-15 and IL-15Ra. hetIL-15 is described in, e.g., U.S. Pat. No. 8,124,084, U.S. 2012/0177598, U.S. 2009/0082299, U.S. 2012/0141413, and U.S. 2011/0081311. In some embodiments, the immunomodulatory agent can contain one or more cytokines. For example, the interleukin can include leukocyte interleukin injection (Multikine), which is a combination of natural cytokines. In some embodiments, the immunomodulatory agent is a Toll-like receptor (TLR) agonist, an adjuvant or a cytokine.

In some embodiments, the additional agent is an agent that ameliorates or neutralizes one or more toxicities or side effects associated with the cell therapy. In some embodiments, the additional agent is selected from among a steroid (e.g., corticosteroid), an inhibitor of TNFα, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitors of TNFα include, but are not limited to, xanthine derivatives (e.g. pentoxifylline) and bupropion. An example of an IL-6 inhibitor is an anti-IL-6 antibody molecule such as tocilizumab, sarilumab, elsilimomab, CNTO 328, ALD518/BMS-945429, CNTO 136, CPSI-2364, CDP6038, VX30, ARGX-109, FE301, and FM101. In some embodiments, the anti-IL-6 antibody molecule is tocilizumab. In some embodiments, the additional agent is an IL-1R inhibitor, such as anakinra.

In some embodiments, the additional agent is a modulator of adenosine levels and/or an adenosine pathway component. Adenosine can function as an immunomodulatory agent in the body. For example, adenosine and some adenosine analogs that non-selectively activate adenosine receptor subtypes decrease neutrophil production of inflammatory oxidative products (Cronstein et al., Ann. N.Y. Acad. Sci. 451:291, 1985; Roberts et al., Biochem. J., 227:669, 1985; Schrier et al., J. Immunol. 137:3284, 1986; Cronstein et al., Clinical Immunol. Immunopath. 42:76, 1987). In some cases, concentration of extracellular adenosine or adenosine analogs can increase in specific environments, e.g., tumor microenvironment (TME). In some cases, adenosine or adenosine analog signaling depends on hypoxia or factors involved in hypoxia or its regulation, e.g., hypoxia inducible factor (HIF). In some embodiments, increase in adenosine signaling can increase in intracellular cAMP and cAMP-dependent protein kinase that results in inhibition of proinflammatory cytokine production, and can lead to the synthesis of immunosuppressive molecules and development of Tregs (Sitkovsky et al., Cancer Immunol Res (2014) 2(7): 598-605). In some embodiments, the additional agent can reduce or reverse immunosuppressive effects of adenosine, adenosine analogs and/or adenosine signaling. In some embodiments, the additional agent can reduce or reverse hypoxia-driven A2-adenosinergic T cell immunosuppression. In some embodiments, the additional agent is selected from among antagonists of adenosine receptors, extracellular adenosine-degrading agents, inhibitors of adenosine generation by CD39/CD73 ectoenzymes, and inhibitors of hypoxia-HIF-1α signaling. In some embodiments, the additional agent is an adenosine receptor antagonist or agonist.

Inhibition or reduction of extracellular adenosine or the adenosine receptor by virtue of an inhibitor of extracellular adenosine (such as an agent that prevents the formation of, degrades, renders inactive, and/or decreases extracellular adenosine), and/or an adenosine receptor inhibitor (such as an adenosine receptor antagonist) can enhance immune response, such as a macrophage, neutrophil, granulocyte, dendritic cell, T- and/or B cell-mediated response. In addition, inhibitors of the Gs protein mediated cAMP dependent intracellular pathway and inhibitors of the adenosine receptor-triggered Gi protein mediated intracellular pathways, can also increase acute and chronic inflammation.

In some embodiments, the additional agent is an adenosine receptor antagonist or agonist, e.g., an antagonist or agonist of one or more of the adenosine receptors A2a, A2b, A1, and A3. A1 and A3 inhibit, and A2a and A2b stimulate, respectively, adenylate cyclase activity. Certain adenosine receptors, such as A2a, A2b, and A3, can suppress or reduce the immune response during inflammation. Thus, antagonizing immunosuppressive adenosine receptors can augment, boost or enhance immune response, e.g., immune response from administered cells, e.g., CAR-expressing T cells. In some embodiments, the additional agent inhibits the production of extracellular adenosine and adenosine-triggered signaling through adenosine receptors. For example, enhancement of an immune response, local tissue inflammation, and targeted tissue destruction can be enhanced by inhibiting or reducing the adenosine-producing local tissue hypoxia; by degrading (or rendering inactive) accumulated extracellular adenosine; by preventing or decreasing expression of adenosine receptors on immune cells; and/or by inhibiting/antagonizing signaling by adenosine ligands through adenosine receptors.

An antagonist is any substance that tends to nullify the action of another, as an agent that binds to a cell receptor without eliciting a biological response. In some embodiments, the antagonist is a chemical compound that is an antagonist for an adenosine receptor, such as the A2a, A2b, or A3 receptor. In some embodiments, the antagonist is a peptide, or a pepidomimetic, that binds the adenosine receptor but does not trigger a Gi protein dependent intracellular pathway. Exemplary antagonists are described in U.S. Pat. Nos. 5,565,566; 5,545,627, 5,981,524; 5,861,405; 6,066, 642; 6,326,390; 5,670,501; 6,117,998; 6,232,297; 5,786, 360; 5,424,297; 6,313,131, 5,504,090; and 6,322,771.

In some embodiments, the additional agent is an A2 receptor (A2R) antagonist, such as an A2a antagonist. Exemplary A2R antagonists include KW6002 (istradefyline), SCH58261, caffeine, paraxanthine, 3,7-dimethyl-1-propargylxanthine (DMPX), 8-(m-chlorostyryl) caffeine (CSC), MSX-2, MSX-3, MSX-4, CGS-15943, ZM-241385, SCH-442416, preladenant, vipadenant (BII014), V2006, ST-1535, SYN-115, PSB-1115, ZM241365, FSPTP, and an inhibitory nucleic acid targeting A2R expression, e.g., siRNA or shRNA, or any antibodies or antigen-binding fragment thereof that targets an A2R. In some embodiments, the additional agent is an A2R antagonist described in, e.g., Ohta et al., Proc Natl Acad Sci USA (2006) 103:13132-13137; Jin et al., Cancer Res. (2010) 70(6):2245-2255; Leone et al., Computational and Structural Biotechnology Journal (2015) 13:265-272; Beavis et al., Proc Natl Acad Sci USA (2013) 110:14711-14716; and Pinna, A., Expert Opin Investig Drugs (2009) 18:1619-1631; Sitkovsky et al., Cancer Immunol Res (2014) 2(7):598-605; U.S. Pat. Nos. 8,080, 554; 8,716,301; US 20140056922; WO2008/147482; U.S. Pat. No. 8,883,500; US 20140377240; WO02/055083; U.S. Pat. Nos. 7,141,575; 7,405,219; 8,883,500; 8,450,329 and 8,987,279).

In some embodiments, the antagonist is an antisense molecule, inhibitory nucleic acid molecule (e.g., small inhibitory RNA (siRNA)) or catalytic nucleic acid molecule (e.g. a ribozyme) that specifically binds mRNA encoding an adenosine receptor. In some embodiments, the antisense molecule, inhibitory nucleic acid molecule or catalytic nucleic acid molecule binds nucleic acids encoding A2a, A2b, or A3. In some embodiments, an antisense molecule, inhibitory nucleic acid molecule or catalytic nucleic acid targets biochemical pathways downstream of the adenosine receptor. For example, the antisense molecule or catalytic nucleic acid can inhibit an enzyme involved in the Gs protein- or Gi protein-dependent intracellular pathway. In some embodiments, the additional agent includes dominant negative mutant form of an adenosine receptor, such as A2a, A2b, or A3.

In some embodiments, the additional agent that inhibits extracellular adenosine includes agents that render extracellular adenosine non-functional (or decrease such function), such as a substance that modifies the structure of adenosine to inhibit the ability of adenosine to signal through adenosine receptors. In some embodiments, the additional agent is an extracellular adenosine-generating or adenosine-degrading enzyme, a modified form thereof or a modulator thereof. For example, in some embodiments, the additional agent is an enzyme (e.g. adenosine deaminase) or another catalytic molecule that selectively binds and destroys the adenosine, thereby abolishing or significantly decreasing the ability of endogenously formed adenosine to signal through adenosine receptors and terminate inflammation.

In some embodiments, the additional agent is an adenosine deaminase (ADA) or a modified form thereof, e.g., recombinant ADA and/or polyethylene glycol-modified ADA (ADA-PEG), which can inhibit local tissue accumulation of extracellular adenosine. ADA-PEG has been used in treatment of patients with ADA SCID (Hershfield (1995) Hum Mutat. 5:107). In some embodiments, an agent that inhibits extracellular adenosine includes agents that prevent or decrease formation of extracellular adenosine, and/or prevent or decrease the accumulation of extracellular adenosine, thereby abolishing, or substantially decreasing, the immunosuppressive effects of adenosine. In some embodiments, the additional agent specifically inhibits enzymes and proteins that are involved in regulation of synthesis and/or secretion of pro-inflammatory molecules, including modulators of nuclear transcription factors. Suppression of adenosine receptor expression or expression of the Gs protein- or Gi protein-dependent intracellular pathway, or the cAMP dependent intracellular pathway, can result in an increase/enhancement of immune response.

In some embodiments, the additional agent can target ectoenzymes that generate or produce extracellular adenosine. In some embodiments, the additional agent targets CD39 and CD73 ectoenzymes, which function in tandem to generate extracellular adenosine. CD39 (also called ecto-nucleoside triphosphate diphosphohydrolase) converts extracellular ATP (or ADP) to 5'AMP. Subsequently, CD73 (also called 5'nucleotidase) converts 5'AMP to adenosine. The activity of CD39 is reversible by the actions of NDP kinase and adenylate kinase, whereas the activity of CD73 is irreversible. CD39 and CD73 are expressed on tumor stromal cells, including endothelial cells and Tregs, and also on many cancer cells. For example, the expression of CD39 and CD73 on endothelial cells is increased under the hypoxic conditions of the tumor microenvironment. Tumor hypoxia can result from inadequate blood supply and disorganized tumor vasculature, impairing delivery of oxygen (Carroll and Ashcroft (2005), Expert. Rev. Mol. Med. 7(6): 1-16). Hypoxia also inhibits adenylate kinase (AK), which converts adenosine to AMP, leading to very high extracellular adenosine concentration. Thus, adenosine is released at high concentrations in response to hypoxia, which is a condition that frequently occurs the tumor microenvironment (TME), in or around solid tumors. In some embodiments, the additional agent is one or more of anti-CD39 antibody or antigen binding fragment thereof, anti-CD73 antibody or antigen binding fragment thereof, e.g., MEDI9447 or TY/23, α-β-methylene-adenosine diphosphate (ADP), ARL 67156, POM-3, IPH52 (see, e.g., Allard et al. Clin Cancer Res (2013) 19(20):5626-5635; Hausler et al., Am J Transl Res (2014) 6(2):129-139; Zhang, B., Cancer Res. (2010) 70(16):6407-6411).

In some embodiments, the additional agent is an inhibitor of hypoxia inducible factor 1 alpha (HIF-1α) signaling. Exemplary inhibitors of HIF-1α include digoxin, acriflavine, sirtuin-7 and ganetespib.

In some embodiments, the additional agent includes a protein tyrosine phosphatase inhibitor, e.g., a protein tyrosine phosphatase inhibitor described herein. In some embodiments, the protein tyrosine phosphatase inhibitor is an SHP-1 inhibitor, e.g., an SHP-1 inhibitor described herein, such as, e.g., sodium stibogluconate. In some embodiments, the protein tyrosine phosphatase inhibitor is an SHP-2 inhibitor, e.g., an SHP-2 inhibitor described herein.

In some embodiments, the additional agent is a kinase inhibitor. Kinase inhibitors, such as a CDK4 kinase inhibitor, a BTK kinase inhibitor, a MNK kinase inhibitor, or a DGK kinase inhibitor, can regulate the constitutively active survival pathways that exist in tumor cells and/or modulate the function of immune cells. In some embodiments, the kinase inhibitor is a Bruton's tyrosine kinase (BTK) inhibitor, e.g., ibrutinib. In some embodiments, the kinase inhibitor is a phosphatidylinositol-4,5-bisphosphate 3-kinase (PI3K) inhibitor. In some embodiments, the kinase inhibitor is a CDK4 inhibitor, e.g., a CDK4/6 inhibitor. In some embodiments, the kinase inhibitor is an mTOR inhibitor, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor. In some embodiments, the kinase inhibitor is an MNK inhibitor, or a dual PI3K/mTOR inhibitor. In some embodiments, other exemplary kinase inhibitors include the AKT inhibitor perifosine, the mTOR inhibitor temsirolimus, the Src kinase inhibitors dasatinib and fostamatinib, the JAK2 inhibitors pacritinib and ruxolitinib, the PKCβ inhibitors enzastaurin and bryostatin, and the AAK inhibitor alisertib.

In some embodiments, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In some embodiments, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In some embodiments, the kinase inhibitor is a BTK inhibitor, e.g., ibrutinib (1-[(3R)-3-[4-Amino-3-(4-phenoxyphenyl)-1H-pyrazolo[3,4-d]pyrimidin-1-yl]piperidin-1-yl] prop-2-en-1-one; also known as PCI-32765). In some embodiments, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In some embodiments, 1, 2, 3, 4, 5, 6, 7, 8, 9, 10, 11, 12 or more cycles of ibrutinib are administered. In some embodiments, the BTK inhibitor is a BTK inhibitor described in International Application WO 2015/079417.

In some embodiments, the kinase inhibitor is a PI3K inhibitor. PI3K is central to the PI3K/Akt/mTOR pathway involved in cell cycle regulation and lymphoma survival. Exemplary PI3K inhibitor includes idelalisib (PI3Kδ inhibitor). In some embodiments, the additional agent is idelalisib and rituximab.

In some embodiments, the additional agent is an inhibitor of mammalian target of rapamycin (mTOR). In some embodiments, the kinase inhibitor is an mTOR inhibitor selected from temsirolimus; ridaforolimus (also known as AP23573 and MK8669); everolimus (RAD001); rapamycin (AY22989); simapimod; AZD8055; PF04691502; SF1126; and XL765. In some embodiments, the additional agent is an inhibitor of mitogen-activated protein kinase (MAPK), such as vemurafenib, dabrafenib, and trametinib.

In some embodiments, the additional agent is an agent that regulates pro- or anti-apoptotic proteins. In some embodiments, the additional agent includes a B-cell lymphoma 2 (BCL-2) inhibitor (e.g., venetoclax, also called ABT-199 or GDC-0199; or ABT-737). Venetoclax is a small molecule (4-(4-{[2-(4-Chlorophenyl)-4,4-dimethyl-1-cyclohexen-1-yl]methyl}-1-piperazinyl)-N-({3-nitro-4-[(tetrahydro-2H-pyran-4-ylmethyl)amino]phenyl}sulfonyl)-2-(1H-pyrrolo[2,3-b]pyridin-5-yloxy)benzamide) that inhibits the anti-apoptotic protein, BCL-2. Other agents that modulate pro- or anti-apoptotic protein include BCL-2 inhibitor ABT-737, navitoclax (ABT-263); Mcl-1 siRNA or Mcl-1 inhibitor retinoid N-(4-hydroxyphenyl) retinamide (4-HPR) for maximal efficacy. In some embodiments, the additional agent provides a pro-apoptotic stimuli, such as recombinant tumor necrosis factor-related apoptosis-inducing ligand (TRAIL), which can activate the apoptosis pathway by binding to TRAIL death receptors DR-4 and DR-5 on tumor cell surface, or TRAIL-R2 agonistic antibodies.

In some embodiments, the additional agent includes an indoleamine 2,3-dioxygenase (IDO) inhibitor. IDO is an enzyme that catalyzes the degradation of the amino acid, L-tryptophan, to kynurenine. Many cancers overexpress IDO, e.g., prostatic, colorectal, pancreatic, cervical, gastric, ovarian, head, and lung cancer. Plasmacytoid dendritic cells (pDCs), macrophages, and dendritic cells (DCs) can express IDO. In some aspects, a decrease in L-tryptophan (e.g., catalyzed by IDO) results in an immunosuppressive milieu by inducing T-cell anergy and apoptosis. Thus, in some aspects, an IDO inhibitor can enhance the efficacy of the BCMA-binding recombinant receptors, cells and/or compositions described herein, e.g., by decreasing the suppression or death of the administered CAR-expressing cell. Exemplary inhibitors of IDO include but are not limited to 1-methyl-tryptophan, indoximod (New Link Genetics) (see, e.g., Clinical Trial Identifier Nos. NCT01191216; NCT01792050), and INCB024360 (Incyte Corp.) (see, e.g., Clinical Trial Identifier Nos. NCT01604889; NCT01685255).

In some embodiments, the additional agent includes a cytotoxic agent, e.g., CPX-351 (Celator Pharmaceuticals), cytarabine, daunorubicin, vosaroxin (Sunesis Pharmaceuticals), sapacitabine (Cyclacel Pharmaceuticals), idarubicin, or mitoxantrone. In some embodiments, the additional agent includes a hypomethylating agent, e.g., a DNA methyltransferase inhibitor, e.g., azacitidine or decitabine.

In another embodiment, the additional therapy is transplantation, e.g., an allogeneic stem cell transplant.

In some embodiments, the additional therapy is a lymphodepleting therapy. Lymphodepleting chemotherapy is thought to improve engraftment and activity of recombinant receptor-expressing cells, such as CAR T cells. In some embodiments, lymphodepleting chemotherapy may enhance adoptively transferred tumor-specific T cells to proliferate in vivo through homeostatic proliferation (Grossman 2004, Stachel 2004). In some embodiments, chemotherapy may reduce or eliminate CD4+CD25+ regulatory T cells, which can suppress the function of tumor-targeted adoptively transferred T cells (Turk 2004). In some embodiments, lymphodepleting chemotherapy prior to adoptive T-cell therapy may enhance the expression of stromal cell-derived factor 1 (SDF-1) in the bone marrow, enhancing the homing of modified T cells to the primary tumor site through binding of SDF-1 with CXCR-4 expressed on the T-cell surface (Pinthus 2004). In some embodiments, lymphodepleting chemotherapy may further reduce the subject's tumor burden and potentially lower the risk and severity of CRS.

In some embodiments, lymphodepletion is performed on a subject, e.g., prior to administering engineered cells, e.g., CAR-expressing cells. In some embodiments, the lymphodepletion comprises administering one or more of melphalan, Cytoxan, cyclophosphamide, and/or fludarabine. In some embodiments, a lymphodepleting chemotherapy is administered to the subject prior to, concurrently with, or after administration (e.g., infusion) of engineered cells, e.g., CAR-expressing cells. In an example, the lymphodepleting chemotherapy is administered to the subject prior to administration of engineered cells, e.g., CAR-expressing cells. In some embodiments the lymphodepleting chemotherapy is administered 1 to 10 days prior to administration of engineered cells, such as 1, 2, 3, 4, 5, 6, 7, 8, 9, or 10 days prior to the initiation of administration of engineered cells, or at least 2 days prior, such as at least 3, 4, 5, 6, or 7 days prior, to the initiation of administration of engineered cell. In some embodiments, the subject is administered a preconditioning agent no more than 7 days prior, such as no more than 6, 5, 4, 3, or 2 days prior, to the initiation of administration of engineered cell. The number of days after lymphodepleting chemotherapy that the engineered ells are administered can be determined based on clinical or logistical circumstances. In some examples, dose adjustments or other changes to the lymphodepleting chemotherapy regimen can implemented due to a subject's health, such as the subject's underlying organ function, as determined by the treating physician.

In some embodiments, lymphodepleting chemotherapy comprises administration of a lymphodepleting agent, such as cyclophosphamide, fludarabine, or combinations thereof, In some embodiments, the subject is administered cyclophosphamide at a dose between or between about 20 mg/kg and 100 mg/kg body weight of the subject, such as between or between about 40 mg/kg and 80 mg/kg. In some aspects, the subject is administered about 60 mg/kg of cyclophosphamide. In some embodiments, the cyclophosphamide is administered once daily for one or two days. In some embodiments, where the lymphodepleting agent comprises cyclophosphamide, the subject is administered cyclophosphamide at a dose between or between about 100 mg/m$^2$ and 500 mg/m$^2$ body surface area of the subject, such as between or between about 200 mg/m$^2$ and 400 mg/m$^2$, or 250 mg/m$^2$ and 350 mg/m$^2$, inclusive. In some instances, the subject is administered about 300 mg/m$^2$ of cyclophosphamide. In some embodiments, the cyclophosphamide can be administered in a single dose or can be administered in a plurality of doses, such as given daily, every other day or every three days. In some embodiments, cyclophosphamide is administered daily, such as for 1-5 days, for example, for 2 to 4 days. In some instances, the subject is administered about 300 mg/m$^2$ body surface area of the subject, of cyclophosphamide, daily for 3 days, prior to initiation of the cell therapy.

In some embodiments, where the lymphodepleting agent comprises fludarabine, the subject is administered fludarabine at a dose between or between about 1 mg/m$^2$ and 100 mg/m$^2$ body surface area of the subject, such as between or between about 10 mg/m$^2$ and 75 mg/m$^2$, 15 mg/m$^2$ and 50 mg/m$^2$, 20 mg/m$^2$ and 40 mg/m$^2$, or 24 mg/m$^2$ and 35 mg/m$^2$, inclusive. In some instances, the subject is administered about 30 mg/m$^2$ of fludarabine. In some embodiments, the fludarabine can be administered in a single dose or can be administered in a plurality of doses, such as given daily, every other day or every three days. In some embodiments, fludarabine is administered daily, such as for 1-5 days, for example, for 2 to 4 days. In some instances, the subject is administered about 30 mg/m$^2$ body surface area of the subject, of fludarabine, daily for 3 days, prior to initiation of the cell therapy.

In some embodiments, the lymphodepleting agent comprises a combination of agents, such as a combination of cyclophosphamide and fludarabine. Thus, the combination of agents may include cyclophosphamide at any dose or administration schedule, such as those described above, and fludarabine at any dose or administration schedule, such as those described above. For example, in some aspects, the subject is administered fludarabine at or about 30 mg/m$^2$ body surface area of the subject, daily, and cyclophosphamide at or about 300 mg/m$^2$ body surface area of the subject, daily, for 3 days.

In some embodiments, antiemetic therapy, except dexamethasone or other steroids, may be given prior to lymphodepleting chemotherapy. In some embodiments, Mesna may be used for subjects with a history of hemorrhagic cystitis.

In some embodiments, the additional agent is an oncolytic virus. In some embodiments, oncolytic viruses are capable of selectively replicating in and triggering the death of or slowing the growth of a cancer cell. In some cases, oncolytic viruses have no effect or a minimal effect on non-cancer cells. An oncolytic virus includes but is not limited to an oncolytic adenovirus, oncolytic Herpes Simplex Viruses, oncolytic retrovirus, oncolytic parvovirus, oncolytic vaccinia virus, oncolytic Sinbis virus, oncolytic influenza virus, or oncolytic RNA virus (e.g., oncolytic reovirus, oncolytic Newcastle Disease Virus (NDV), oncolytic measles virus, or oncolytic vesicular stomatitis virus (VSV)).

Other exemplary combination therapy, treatment and/or agents include anti-allergenic agents, anti-emetics, analgesics and adjunct therapies. In some embodiments, the additional agent includes cytoprotective agents, such as neuroprotectants, free-radical scavengers, cardioprotectors, anthracycline extravasation neutralizers and nutrients.

In some embodiments, an antibody used as an additional agent is conjugated or otherwise bound to a therapeutic agent, e.g., a chemotherapeutic agent (e.g., Cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent), anti-allergic agent, anti-nausea agent (or antiemetic), pain reliever, or cytoprotective agent described herein. In some embodiments, the additional agent is an antibody-drug conjugate.

In some embodiments, the additional agent can modulate, inhibit or stimulate particular factors at the DNA, RNA or protein levels, to enhance or boost the efficacy of the BCMA-binding recombinant receptors, cells and/or compositions provided herein. In some embodiments, the additional agent can modulate the factors at the nucleic acid level, e.g., DNA or RNA, within the administered cells, e.g., cells engineered to express recombinant receptors, e.g., CAR. In some embodiments, an inhibitory nucleic acid, e.g., an inhibitory nucleic acid, e.g., a dsRNA, e.g., an siRNA or shRNA, or a clustered regularly interspaced short palindromic repeats (CRISPR), a transcription-activator like effector nuclease (TALEN), or a zinc finger endonuclease (ZFN), can be used to inhibit expression of an inhibitory molecule in the engineered cell, e.g., CAR-expressing cell. In some embodiments the inhibitor is an shRNA. In some embodiments, the inhibitory molecule is inhibited within the engineered cell, e.g., CAR-expressing cell. In some embodiments, a nucleic acid molecule that encodes a dsRNA molecule that inhibits expression of the molecule that modulates or regulates, e.g., inhibits, T-cell function is operably linked to a promoter, e.g., a HI- or a U6-derived promoter such that the dsRNA molecule that inhibits expression of the inhibitory molecule is expressed within the engineered cell, e.g., CAR-expressing cell. See, e.g., Brummelkamp T R, et al. (2002) Science 296: 550-553; Miyagishi M, et al. (2002) Nat. Biotechnol. 19: 497-500.

In some embodiments, the additional agent is capable of disrupting the gene encoding an inhibitory molecule, such as any immune checkpoint inhibitors described herein. In some embodiments, disruption is by deletion, e.g., deletion of an entire gene, exon, or region, and/or replacement with an exogenous sequence, and/or by mutation, e.g., frameshift or missense mutation, within the gene, typically within an exon of the gene. In some embodiments, the disruption results in a premature stop codon being incorporated into the gene, such that the inhibitory molecule is not expressed or is not expressed in a form that is capable of being expressed on the cells surface and/or capable of mediating cell signaling. The disruption is generally carried out at the DNA level. The disruption generally is permanent, irreversible, or not transient.

In some aspects, the disruption is carried out by gene editing, such as using a DNA binding protein or DNA-binding nucleic acid, which specifically binds to or hybridizes to the gene at a region targeted for disruption. In some aspects, the protein or nucleic acid is coupled to or complexed with a nuclease, such as in a chimeric or fusion protein. For example, in some embodiments, the disruption is effected using a fusion comprising a DNA-targeting protein and a nuclease, such as a Zinc Finger Nuclease (ZFN) or TAL-effector nuclease (TALEN), or an RNA-guided nuclease such as a clustered regularly interspersed short palindromic nucleic acid (CRISPR)-Cas system, such as CRISPR-Cas9 system, specific for the gene being disrupted. In some embodiments, methods of producing or generating genetically engineered cells, e.g., CAR-expressing cells, include introducing into a population of cells nucleic acid molecules encoding a genetically engineered antigen receptor (e.g. CAR) and nucleic acid molecules encoding an agent targeting an inhibitory molecule that is a gene editing nuclease, such as a fusion of a DNA-targeting protein and a nuclease such as a ZFN or a TALEN, or an RNA-guided nuclease such as of the CRISPR-Cas9 system, specific for an inhibitory molecule.

Any of the additional agents described herein can be prepared and administered as combination therapy with the BCMA-binding recombinant receptor (e.g., chimeric antigen receptor) and/or engineered cells expressing said molecules (e.g., recombinant receptor) described herein, such as in pharmaceutical compositions comprising one or more agents of the combination therapy and a pharmaceutically acceptable carrier, such as any described herein. In some embodiments, the BCMA-binding recombinant receptor (e.g., chimeric antigen receptor), engineered cells expressing said molecules (e.g., recombinant receptor), plurality of engineered cells expressing said molecules (e.g., recombinant receptor) can be administered simultaneously, concurrently or sequentially, in any order with the additional agents, therapy or treatment, wherein such administration provides therapeutically effective levels each of the agents in the body of the subject. In some embodiments, the additional agent can be co-administered with the BCMA-binding recombinant receptors, cells and/or compositions described herein, for example, as part of the same pharmaceutical composition or using the same method of delivery. In some embodiments, the additional agent is administered simultaneously with the BCMA-binding recombinant receptors, cells and/or compositions described herein, but in separate compositions. In some embodiments, the additional agent is an additional engineered cell, e.g., cell engineered to express a different recombinant receptor, and is administered in the same composition or in a separate composition. In some embodiments, the additional agent is incubated with the engineered cell, e.g., CAR-expressing cells, prior to administration of the cells.

In some examples, the one or more additional agents are administered subsequent to or prior to the administration of the BCMA-binding recombinant receptors, cells and/or compositions described herein, separated by a selected time period. In some examples, the time period is 1 day, 2 days, 3 days, 4 days, 5 days, 6 days, 1 week, 2 weeks, 3 weeks, 1 month, 2 months, or 3 months. In some examples, the one or more additional agents are administered multiple times and/or the BCMA-binding recombinant receptors, cells and/or or compositions described herein, is administered multiple times. For example, in some embodiments, the additional agent is administered prior to the BCMA-binding recombinant receptors, cells and/or compositions described herein, e.g., two weeks, 12 days, 10 days, 8 days, one week, 6 days, 5 days, 4 days, 3 days, 2 days or 1 day before the administration. For example, in some embodiments, the additional agent is administered after the BCMA-binding recombinant receptors, cells and/or compositions described herein, e.g., two weeks, 12 days, 10 days, 8 days, one week, 6 days, 5 days, 4 days, 3 days, 2 days or 1 day after the administration.

The dose of the additional agent can be any therapeutically effective amount, e.g., any dose amount described herein, and the appropriate dosage of the additional agent may depend on the type of disease to be treated, the type, dose and/or frequency of the recombinant receptor, cell and/or composition administered, the severity and course of the disease, whether the recombinant receptor, cell and/or composition is administered for preventive or therapeutic purposes, previous therapy, the patient's clinical history and response to the recombinant receptor, cell and/or composition, and the discretion of the attending physician. The recombinant receptor, cell and/or composition and/or the additional agent and/or therapy can be administered to the patient at one time, repeated or administered over a series of treatments.

VI. ARTICLES OF MANUFACTURE OR KITS

Also provided are articles of manufacture or kit containing the provided recombinant receptors (e.g., CARs), genetically engineered cells, and/or compositions comprising the same. The articles of manufacture may include a container and a label or package insert on or associated with the container. Suitable containers include, for example, bottles, vials, syringes, test tubes, IV solution bags, etc. The containers may be formed from a variety of materials such as glass or plastic. In some embodiments, the container has a sterile access port. Exemplary containers include an intravenous solution bags, vials, including those with stoppers pierceable by a needle for injection. The article of manufacture or kit may further include a package insert indicating that the compositions can be used to treat a particular condition such as a condition described herein (e.g., multiple myeloma). Alternatively, or additionally, the article of manufacture or kit may further include another or the same container comprising a pharmaceutically-acceptable buffer. It may further include other materials such as other buffers, diluents, filters, needles, and/or syringes.

The label or package insert may indicate that the composition is used for treating the BCMA-expressing or BCMA-associated disease, disorder or condition in an individual. The label or a package insert, which is on or associated with the container, may indicate directions for reconstitution and/or use of the formulation. The label or package insert may further indicate that the formulation is useful or intended for subcutaneous, intravenous, or other modes of administration for treating or preventing a BCMA-expressing or BCMA-associated disease, disorder or condition in an individual.

The container in some embodiments holds a composition which is by itself or combined with another composition effective for treating, preventing and/or diagnosing the condition. The article of manufacture or kit may include (a) a first container with a composition contained therein (i.e., first medicament), wherein the composition includes the antibody (e.g., anti-BCMA antibody) or antigen-binding fragment thereof or recombinant receptor (e.g., CAR); and (b) a second container with a composition contained therein (i.e., second medicament), wherein the composition includes a further agent, such as a cytotoxic or otherwise therapeutic agent, and which article or kit further comprises instructions on the label or package insert for treating the subject with the second medicament, in an effective amount.

VII. DEFINITIONS

As used herein, reference to a "corresponding form" of an antibody means that when comparing a property or activity of two antibodies, the property is compared using the same form of the antibody. For example, if it is stated that an antibody has greater activity compared to the activity of the corresponding form of a first antibody, that means that a particular form, such as an scFv of that antibody, has greater activity compared to the scFv form of the first antibody.

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The terms "full length antibody," "intact antibody," and "whole antibody" are used herein interchangeably to refer to an antibody having a structure substantially similar to a native antibody structure or having heavy chains that contain an Fc region as defined herein.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., J. Chromatogr. B 848:79-87 (2007).

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding an anti-BCMA antibody" refers to one or more nucleic acid molecules encoding antibody heavy and light chains (or fragments thereof), including such nucleic acid molecule(s) in a single vector or separate vectors, and such nucleic acid molecule(s) present at one or more locations in a host cell.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

The terms "polypeptide" and "protein" are used interchangeably to refer to a polymer of amino acid residues, and are not limited to a minimum length. Polypeptides, including the antibodies and antibody chains and other peptides, e.g., linkers and BCMA-binding peptides, may include amino acid residues including natural and/or non-natural amino acid residues. The terms also include post-expression modifications of the polypeptide, for example, glycosylation, sialylation, acetylation, phosphorylation, and the like. In some aspects, the polypeptides may contain modifications with respect to a native or natural sequence, as long as the protein maintains the desired activity. These modifications may be deliberate, as through site-directed mutagenesis, or may be accidental, such as through mutations of hosts which produce the proteins or errors due to PCR amplification.

As used herein, "percent (%) amino acid sequence identity" and "percent identity" and "sequence identity" when used with respect to an amino acid sequence (reference polypeptide sequence) is defined as the percentage of amino acid residues in a candidate sequence (e.g., the subject antibody or fragment) that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

An amino acid substitution may include replacement of one amino acid in a polypeptide with another amino acid. Amino acid substitutions may be introduced into a binding molecule, e.g., antibody, of interest and the products screened for a desired activity, e.g., retained/improved antigen binding, or decreased immunogenicity.

Amino acids generally can be grouped according to the following common side-chain properties:
  (1) hydrophobic: Norleucine, Met, Ala, Val, Leu, Ile;
  (2) neutral hydrophilic: Cys, Ser, Thr, Asn, Gln;
  (3) acidic: Asp, Glu;
  (4) basic: His, Lys, Arg;
  (5) residues that influence chain orientation: Gly, Pro;
  (6) aromatic: Trp, Tyr, Phe.

Non-conservative amino acid substitutions will involve exchanging a member of one of these classes for another class.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, the singular forms "a," "an," and "the" include plural referents unless the context clearly dictates otherwise. For example, "a" or "an" means "at least one" or "one or more." It is understood that aspects, embodiments, and variations described herein include "comprising," "consisting," and/or "consisting essentially of" aspects, embodiments and variations.

Throughout this disclosure, various aspects of the claimed subject matter are presented in a range format. It should be understood that the description in range format is merely for convenience and brevity and should not be construed as an inflexible limitation on the scope of the claimed subject matter. Accordingly, the description of a range should be considered to have specifically disclosed all the possible sub-ranges as well as individual numerical values within that range. For example, where a range of values is provided, it is understood that each intervening value, between the upper and lower limit of that range and any other stated or intervening value in that stated range is encompassed within the claimed subject matter. The upper and lower limits of these smaller ranges may independently be included in the smaller ranges, and are also encompassed within the claimed subject matter, subject to any specifically excluded limit in the stated range. Where the stated range includes one or both of the limits, ranges excluding either or both of those included limits are also included in the claimed subject matter. This applies regardless of the breadth of the range.

The term "about" as used herein refers to the usual error range for the respective value readily known to the skilled person in this technical field. Reference to "about" a value or parameter herein includes (and describes) embodiments that are directed to that value or parameter per se. For example, description referring to "about X" includes description of "X".

As used herein, a "composition" refers to any mixture of two or more products, substances, or compounds, including cells. It may be a solution, a suspension, liquid, powder, a paste, aqueous, non-aqueous or any combination thereof.

As used herein, a statement that a cell or population of cells is "positive" for a particular marker refers to the detectable presence on or in the cell of a particular marker, typically a surface marker. When referring to a surface marker, the term refers to the presence of surface expression as detected by flow cytometry, for example, by staining with an antibody that specifically binds to the marker and detecting said antibody, wherein the staining is detectable by flow cytometry at a level substantially above the staining detected carrying out the same procedure with an isotype-matched control under otherwise identical conditions and/or at a level substantially similar to that for cell known to be positive for the marker, and/or at a level substantially higher than that for a cell known to be negative for the marker.

As used herein, a statement that a cell or population of cells is "negative" for a particular marker refers to the absence of substantial detectable presence on or in the cell of a particular marker, typically a surface marker. When referring to a surface marker, the term refers to the absence of surface expression as detected by flow cytometry, for example, by staining with an antibody that specifically binds to the marker and detecting said antibody, wherein the staining is not detected by flow cytometry at a level substantially above the staining detected carrying out the same procedure with an isotype-matched control under otherwise identical conditions, and/or at a level substantially lower than that for cell known to be positive for the marker, and/or at a level substantially similar as compared to that for a cell known to be negative for the marker.

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

VIII. EXEMPLARY EMBODIMENTS

Among the embodiments provided herein are:

1. A polynucleotide encoding a chimeric antigen receptor, comprising nucleic acid encoding: (a) an extracellular antigen-binding domain that specifically recognizes an antigen; (b) a spacer of at least 125 amino acids in length; (c) a transmembrane domain; and (d) an intracellular signaling region, wherein following expression of the polynucleotide in a cell, the transcribed RNA, optionally messenger RNA (mRNA), from the polynucleotide, exhibits at least 70%, 75%, 80%, 85%, 90%, or 95% RNA homogeneity.

2. The polynucleotide of embodiment 1, wherein the spacer is derived from an immunoglobulin.

3. The polynucleotide of embodiment 1 or embodiment 2, wherein the spacer comprises a sequence of a hinge region, a $C_H2$ and $C_H3$ region.

4. The polynucleotide of any of embodiments 1-3, wherein the encoded spacer is or comprises (i) the sequence set forth in SEQ ID NO: 649; (ii) a functional variant of SEQ ID NO:649 that has at least 95%, 96%, 97%, 98% or 99% sequence identity to SEQ ID NO:649; or (iii) a contiguous portion of (i) or (ii) that is at least 125 amino acids in length.

5. The polynucleotide of any of embodiments 1-4, wherein the nucleic acid encoding the spacer comprises at least one modified splice donor and/or splice acceptor site, said modified splice donor and/or acceptor site comprising one or more nucleotide modifications corresponding to a reference splice donor site and/or reference splice acceptor site contained in the sequence set forth in SEQ ID NO:621.

6. The polynucleotide of embodiment 5, wherein the one or more nucleotide modifications comprise an insertion, deletion, substitution or combinations thereof.

7. The polynucleotide of embodiment 5 or embodiment 6, wherein the reference splice acceptor and/or reference splice donor sites are canonical, non-canonical, or cryptic splice sites.

8. The polynucleotide of any of embodiment 5-7, wherein:
the reference splice donor and/or reference splice acceptor site(s) has a splice site prediction score of at least or about 0.4, 0.5, 0.6, 0.70, 0.75, 0.80, 0.85, 0.90, 0.95, 0.99, or 1.0; and/or
the reference splice donor and/or reference splice acceptor site(s) is/are predicted to be involved in a splice event with a probability of at least 40%, 50%, 60%, 70%, 75%, 80%, 85%, 90%, 95%, 99%, or 100%.

9. The polynucleotide of any of embodiments 5-8, wherein:
the reference splice donor site comprises the sequence aatctaagtacggac (SEQ ID NO: 705), tcaactggtacgtgg (SEQ ID NO:706), acaattagtaaggca (SEQ ID NO:707) and/or accacaggtgtatac (SEQ ID NO:708); and/or
the reference splice acceptor site comprises the sequence

```
                                           (SEQ ID NO: 742)
   aagtttctttctgtattccaggctgaccgtggataaatctc
   and/or (SEQ ID NO: 743)
   gggcaacgtgttctcttgcagtgtcatgcacgaagccctgc.
```

10. The polynucleotide of any of embodiment 5-8, wherein:
the reference splice donor and/or reference splice acceptor site(s) has a splice site prediction score of at least or about 0.70, 0.75, 0.80, 0.85, 0.90, 0.95, 0.99, or 1.0; and/or
the reference splice donor and/or reference splice acceptor site(s) is/are predicted to be involved in a splice event with a probability of at least 70%, 75%, 80%, 85%, 90%, 95%, 99%, or 100%.

11. The polynucleotide of any of embodiments 5-8 and 10, wherein:
the reference splice donor site comprises the sequence tcaactggtacgtgg (SEQ ID NO:706); and/or
the reference splice acceptor site comprises the sequence aagtttctttctgtattccaggctgaccgtggataaatctc (SEQ ID NO:742).

12. The polynucleotide of any of embodiments 5-11, wherein at least one of the one or more nucleotide modifications are within 1, 2, 3, 4, 5, 6, 7, 8, 9 or 10 residues of the splice site junction of the reference splice acceptor and/or reference splice donor site.

13. The polynucleotide of any of embodiments 5-12, wherein the one or more nucleotide modifications is silent and/or results in a degenerate codon compared to SEQ ID NO:621 and/or does not change the amino acid sequence of the encoded spacer.

14. The polynucleotide of any of embodiments 5-9 and 12-13, wherein:
the modified splice donor site is set forth in agtctaaatacggac (SEQ ID NO:661), tcaactggtatgtgg (SEQ ID NO:662), accatctccaaggcc (SEQ ID NO:663) and/or gccccaggtttacac (SEQ ID NO:664); and/or
the modified splice acceptor site is set forth in cagtttcttcctgtatagtagactcaccgtggataaatcaa (SEQ ID NO:672), gggcaacgtgttcagctgcagcgtgatgcacgaggccctgc (SEQ ID NO: 673) and/or cgccttgtcctccttgtcccgctcctcctgttgccggacct (SEQ ID NO:766).

15. The polynucleotide of any of embodiments 5-14, wherein the modified splice donor site is set forth in tcaactggtatgtgg (SEQ ID NO:662) and/or the modified acceptor site is set forth in

```
                                           (SEQ ID NO: 672)
   cagtttcttcctgtatagtagactcaccgtggataaatcaa
   and/or (SEQ ID NO: 766)
   cgccttgtcctccttgtcccgctcctcctgttgccggacct.
```

16. The polynucleotide of any of embodiments 1-15, wherein the spacer is encoded by a sequence of nucleotide set forth in SEQ ID NO:622 or a portion thereof.

17. A polynucleotide encoding a chimeric antigen receptor, wherein the polynucleotide comprises nucleic acid encoding: (a) an extracellular antigen-binding domain that specifically recognizes an antigen; (b) a spacer, wherein the encoding nucleic acid is or comprises the sequence set forth in SEQ ID NO:622 or encodes a sequence of amino acids set forth in SEQ ID NO:649; (c) a transmembrane domain; and (d) an intracellular signaling region.

18. A polynucleotide encoding a chimeric antigen receptor, wherein the polynucleotide comprises nucleic acid encoding: (a) an extracellular antigen-binding domain that specifically recognizes an antigen; (b) a spacer, wherein the encoding nucleic acid consists or consists essentially of the sequence set forth in SEQ ID NO:622 or encodes a sequence of amino acids set forth in SEQ ID NO:649; (c) a transmembrane domain; and (d) an intracellular signaling region.

19. The polynucleotide of embodiment 17 or embodiment 18, wherein following expression of the polynucleotide in a cell, the transcribed RNA, optionally messenger RNA (mRNA), from the polynucleotide, exhibits at least 70%, 75%, 80%, 85%, 90%, or 95% RNA homogeneity.

20. The polynucleotide of any of embodiments 1-19, wherein, following expression in a cell, the transcribed RNA, optionally messenger RNA (mRNA), from the polynucleotide exhibits reduced heterogeneity compared to the heterogeneity of the mRNA transcribed from a reference polynucleotide, said reference polynucleotide encoding the same amino acid sequence as the polynucleotide, wherein the reference polynucleotide differs by the presence of one or more splice donor site and/or one or more splice acceptor site in the nucleic acid encoding the spacer and/or comprises one or more nucleotide modifications compared to the polynucleotide.

21. The polynucleotide of embodiment 20, wherein the RNA heterogeneity is reduced by greater than or greater than about 10%, 15%, 20%, 25%, 30%, 40%, 50% or more.

22. The polynucleotide of embodiment 20 or embodiment 21, wherein the transcribed RNA, optionally messenger RNA (mRNA), from the reference polynucleotide exhibits greater than or greater than about 10%, 15%, 20%, 25%, 30%, 40%, 50% or more RNA heterogeneity.

23. The polynucleotide of any of embodiments 1-22, wherein the RNA homogeneity and/or heterogeneity is determined by agarose gel electrophoresis, chip-based capillary electrophoresis, analytical ultracentrifugation, field flow fractionation, or liquid chromatography.

24. The polynucleotide of any of embodiments 1-23, wherein the polynucleotide is codon-optimized.

25. The polynucleotide of any of embodiments 1-24, wherein the antigen is associated with the disease or condition or expressed in cells of the environment of a lesion associated with the disease or condition.

26. The polynucleotide of any of embodiments 1-25, wherein the disease or condition is a cancer.

27. The polynucleotide of any of embodiments 1-26, wherein the disease or condition is a myeloma, leukemia or lymphoma.

28. The polynucleotide of any of embodiments 1-27, wherein the antigen is ROR1, B cell maturation antigen (BCMA), carbonic anhydrase 9 (CAIX), tEGFR, Her2/neu (receptor tyrosine kinase erbB2), L1-CAM, CD19, CD20, CD22, mesothelin, CEA, and hepatitis B surface antigen, anti-folate receptor, CD23, CD24, CD30, CD33, CD38, CD44, EGFR, epithelial glycoprotein 2 (EPG-2), epithelial glycoprotein 40 (EPG-40), EPHa2, erb-B2, erb-B3, erb-B4, erbB dimers, EGFR vIII, folate binding protein (FBP), FCRL5, FCRH5, fetal acetylcholine receptor, GD2, GD3, HMW-MAA, IL-22R-alpha, IL-13R-alpha2, kinase insert domain receptor (kdr), kappa light chain, Lewis Y, L1-cell adhesion molecule, (L1-CAM), Melanoma-associated antigen (MAGE)-A1, MAGE-A3, MAGE-A6, Preferentially expressed antigen of melanoma (PRAME), survivin, TAG72, B7-H6, IL-13 receptor alpha 2 (IL-13Ra2), CA9, GD3, HMW-MAA, CD171, G250/CAIX, HLA-AI MAGE A1, HLA-A2 NY-ESO-1, PSCA, folate receptor-a, CD44v6, CD44v7/8, avb6 integrin, 8H9, NCAM, VEGF receptors, 5T4, Foetal AchR, NKG2D ligands, CD44v6, dual antigen, a cancer-testes antigen, mesothelin, murine CMV, mucin 1 (MUC1), MUC16, PSCA, NKG2D, NY-ESO-1, MART-1, gp100, oncofetal antigen, ROR1, TAG72, VEGF-R2, carcinoembryonic antigen (CEA), Her2/neu, estrogen receptor, progesterone receptor, ephrinB2, CD123, c-Met, GD-2, 0-acetylated GD2 (OGD2), CE7, Wilms Tumor 1 (WT-1), a cyclin, cyclin A2, CCL-1, CD138, a pathogen-specific antigen.

29. The polynucleotide of embodiment 28, wherein the antigen is B cell maturation antigen (BCMA).

30. The polynucleotide of any of embodiments 1-29, wherein the antigen-binding domain is an antibody fragment comprising a variable heavy chain ($V_H$) and a variable light chain ($V_L$) region.

31. The polynucleotide of embodiment 30, wherein:
the $V_H$ region is or comprises an amino acid sequence having at least 90%, 91%, 92%, 93%, 94%, 95%, 96%, 97%, 98% or 99% sequence identity to the $V_H$ region amino acid sequence set forth in any of SEQ ID NOs:110-115, 247-256, 324, 325, 518-531, 533, 609, 617, 772-774, or 814-832; and/or
the $V_L$ region is or comprises an amino acid sequence having at least 90%, 91%, 92%, 93%, 94%, 95%, 96%, 97%, 98%, or 99% sequence identity to the $V_L$ region amino acid sequence set forth in any of SEQ ID NOs:116-127, 257-267, 326, 327, 534-550, 552-557, 610, 618, 775-777, or 833-849.

32. The polynucleotide of embodiment 30 or embodiment 31, wherein:
the $V_H$ region is or comprises an amino acid sequence having at least 90%, 91%, 92%, 93%, 94%, 95%, 96%, 97%, 98% or 99% sequence identity to the $V_H$ region amino acid sequence set forth in any of SEQ ID NOs: 110, 111, 112, 113, 115, 248, 252, 253, 254, 255, 256, 324, 325, 518, 519, 520, 521, 522, 609 or 617; and/or the $V_L$ region is or comprises an amino acid sequence having at least 90%, 91%, 92%, 93%, 94%, 95%, 96%, 97%, 98%, or 99% sequence identity to the $V_L$ region amino acid sequence set forth in any of SEQ ID NOs: 116, 117, 118, 120, 121, 124, 125, 258, 262, 263, 264, 265, 266, 267, 326, 327, 534, 535, 536, 537, 538, 610 or 618.

33. The polynucleotide of embodiment 30 or embodiment 31, wherein:
the $V_H$ region is or comprises a CDR-H1, CDR-H2 and CDR-H3 contained within the $V_H$ region amino acid sequence selected from any one of SEQ ID NOs:110-115, 247-256, 324, 325, 518-531, 533, 609, 617, 772-774, or 814-832; and/or
the $V_L$ region is or comprises a CDR-L1, CDR-L2 and CDR-L3 contained within the $V_L$ region amino acid sequence selected from any one of SEQ ID NOs:116-127, 257-267, 326, 327, 534-550, 552-557, 610, 618, 775-777, or 833-849.

34. The polynucleotide of any of embodiments 30-33, wherein:
the $V_H$ region is or comprises a CDR-H1, CDR-H2 and CDR-H3 contained within the $V_H$ region amino acid sequence selected from any one of SEQ ID NOs: 110, 111, 112, 113, 115, 248, 252, 253, 254, 255, 256, 324, 325, 518, 519, 520, 521, 522, 609 or 617; and/or the $V_L$ region is or comprises a CDR-L1, CDR-L2 and CDR-L3 contained within the $V_L$ region amino acid sequence selected from any one of SEQ ID NOs: 116, 117, 118, 120, 121, 124, 125, 258, 262, 263, 264, 265, 266, 267, 326, 327, 534, 535, 536, 537, 538, 610 or 618.

The polynucleotide of any of embodiments 30-34, wherein:
the $V_H$ region is or comprises (a) a heavy chain complementarity determining region 1 (CDR-H1) comprising the amino acid sequence selected from any one of SEQ ID NOs:1-3, 140-144, 288, 289, 294, 295, 507, 532, 593, 596, 604, 611; and/or (b) a heavy chain complementarity determining region 2 (CDR-H2) comprising the amino acid sequence selected from any one of SEQ ID NOs:4-6, 145-148, 290, 291, 296, 297, 372-374, 513, 551, 594, 597, 605, 612; and (c) a heavy chain complementarity determining region 3 (CDR-H3) comprising the amino acid sequence selected from any one of SEQ ID NOs:7-11, 149-157, 279-287, 292, 293, 376-378, 517, 595, 606, 613; and/or the $V_L$ region is or comprises (a) a light chain complementarity determining region 1 (CDR-L1) comprising the amino acid sequence selected from any one of SEQ ID NOs:26-36, 174-178, 302, 303, 380-392, 394-398, 589, 601, 607 or 614; (b) a light chain complementarity determining region 2 (CDR-L2) comprising the amino acid sequence selected from any one of SEQ ID NOs:37-46, 179-183, 304, 305, 399-409, 411-414, 590, 602, 608 or 615; and (c) a light chain complementarity determining region 3 (CDR-L3) comprising the amino acid sequence selected from any one of SEQ ID NOs:47-58, 184-194, 306, 307, 415-427, 429-433, 591, or 603.

36. The polynucleotide of any of embodiments 30-35, wherein:

the $V_H$ region is or comprises (a) a heavy chain complementarity determining region 1 (CDR-H1) comprising the amino acid sequence selected from any one of SEQ ID NOs: 1, 2, 3, 141, 143, 144, 288, 289, 507, 593, 604, 611; and/or (b) a heavy chain complementarity determining region 2 (CDR-H2) comprising the amino acid sequence selected from any one of SEQ ID NOs: 4, 5, 6, 145, 147, 148, 290, 291, 372, 513, 594, 605 or 612; and (c) a heavy chain complementarity determining region 3 (CDR-H3) comprising the amino acid sequence selected from any one of SEQ ID NOs: 7, 8, 9, 10, 149, 153, 154, 155, 156, 157, 292, 293, 376, 517, 595, 606 or 613; and/or the $V_L$ region is or comprises (a) a light chain complementarity determining region 1 (CDR-L1) comprising the amino acid sequence selected from any one of SEQ ID NOs: 26, 27, 28, 30, 31, 33, 34, 174, 176, 177, 178, 302, 303, 380, 381, 382, 589, 601, 607 or 614; (b) a light chain complementarity determining region 2 (CDR-L2) comprising the amino acid sequence selected from any one of SEQ ID NOs: 37, 38, 39, 41, 43, 44, 179, 181, 182, 183, 304, 305, 399, 400, 401, 402, 590, 602, 608 or 615; and (c) a light chain complementarity determining region 3 (CDR-L3) comprising the amino acid sequence selected from any one of SEQ ID NOs: 47, 48, 49, 51, 52, 55, 56, 185, 189, 190, 191, 192, 193, 194, 306, 307, 415, 417, 418, 421, 591, or 603.

37. The polynucleotide of any of embodiments 30-36, wherein the $V_H$ region comprises a CDR-H1, CDR-H2, and CDR-H3, selected from:

a CDR-H1, CDR-H2, and CDR-H3 comprising the amino acid sequence of SEQ ID NOs:1, 4, and 7, respectively;

a CDR-H1, CDR-H2, and CDR-H3 comprising the amino acid sequence of SEQ ID NOs:2, 5, and 8, respectively;

a CDR-H1, CDR-H2, and CDR-H3 comprising the amino acid sequence of SEQ ID NOs:2, 5, and 9, respectively;

a CDR-H1, CDR-H2, and CDR-H3 comprising the amino acid sequence of SEQ ID NOs:2, 5, and 10, respectively;

a CDR-H1, CDR-H2, and CDR-H3 comprising the amino acid sequence of SEQ ID NOs:3, 6, and 11, respectively;

a CDR-H1, CDR-H2, and CDR-H3 comprising the amino acid sequence of SEQ ID NOs:140, 145, and 149, respectively;

a CDR-H1, CDR-H2, and CDR-H3 comprising the amino acid sequence of SEQ ID NOs:141, 145, and 149, respectively;

a CDR-H1, CDR-H2, and CDR-H3 comprising the amino acid sequence of SEQ ID NOs:141, 145, and 150, respectively;

a CDR-H1, CDR-H2, and CDR-H3 comprising the amino acid sequence of SEQ ID NOs:142, 146, and 151, respectively;

a CDR-H1, CDR-H2, and CDR-H3 comprising the amino acid sequence of SEQ ID NOs:2, 5, and 152, respectively;

a CDR-H1, CDR-H2, and CDR-H3 comprising the amino acid sequence of SEQ ID NOs:143, 147, and 153, respectively;

a CDR-H1, CDR-H2, and CDR-H3 comprising the amino acid sequence of SEQ ID NOs:144, 148, and 154, respectively;

a CDR-H1, CDR-H2, and CDR-H3 comprising the amino acid sequence of SEQ ID NOs:3, 6, and 155, respectively;

a CDR-H1, CDR-H2, and CDR-H3 comprising the amino acid sequence of SEQ ID NOs:2, 5, and 156, respectively;

a CDR-H1, CDR-H2, and CDR-H3 comprising the amino acid sequence of SEQ ID NOs:2, 5, and 157, respectively;

a CDR-H1, CDR-H2, and CDR-H3 comprising the amino acid sequence of SEQ ID NOs:2, 6, and 376, respectively;

a CDR-H1, CDR-H2, and CDR-H3 comprising the amino acid sequence of SEQ ID NOs:3, 6, and 155, respectively;

a CDR-H1, CDR-H2, and CDR-H3 comprising the amino acid sequence of SEQ ID NOs:3, 372, and 376, respectively;

a CDR-H1, CDR-H2, and CDR-H3 comprising the amino acid sequence of SEQ ID NOs:3, 6, and 376, respectively;

a CDR-H1, CDR-H2, and CDR-H3 comprising the amino acid sequence of SEQ ID NOs:3, 6, and 377, respectively;

a CDR-H1, CDR-H2, and CDR-H3 comprising the amino acid sequence of SEQ ID NOs:2, 373, and 152, respectively;

a CDR-H1, CDR-H2, and CDR-H3 comprising the amino acid sequence of SEQ ID NOs:2, 5, and 378, respectively;

a CDR-H1, CDR-H2, and CDR-H3 comprising the amino acid sequence of SEQ ID NOs:2, 374, and 9, respectively;

a CDR-H1, CDR-H2, and CDR-H3 comprising the amino acid sequence of SEQ ID NOs:593, 594, and 595, respectively;

a CDR-H1, CDR-H2, and CDR-H3 comprising the amino acid sequence of SEQ ID NOs:611, 612, and 613, respectively;

a CDR-H1, CDR-H2, and CDR-H3 comprising the amino acid sequence of SEQ ID NOs:507, 513, and 517, respectively;

a CDR-H1, CDR-H2, and CDR-H3 comprising the amino acid sequence of SEQ ID NOs:604, 605, and 606, respectively;

a CDR-H1, CDR-H2, and CDR-H3 comprising the amino acid sequence of SEQ ID NOs:288, 290, and 292, respectively; or a CDR-H1, CDR-H2, and CDR-H3 comprising the amino acid sequence of SEQ ID NOs:289, 291, and 293, respectively.

38. The polynucleotide of any of embodiments 30-37, wherein the $V_H$ region comprises a CDR-H1, CDR-H2, and CDR-H3, selected from:

a CDR-H1, CDR-H2, and CDR-H3 comprising the amino acid sequence of SEQ ID NOs:1, 4, and 7, respectively;

a CDR-H1, CDR-H2, and CDR-H3 comprising the amino acid sequence of SEQ ID NOs:2, 5, and 8, respectively;

a CDR-H1, CDR-H2, and CDR-H3 comprising the amino acid sequence of SEQ ID NOs:2, 5, and 9, respectively;

a CDR-H1, CDR-H2, and CDR-H3 comprising the amino acid sequence of SEQ ID NOs:2, 5, and 10, respectively;

a CDR-H1, CDR-H2, and CDR-H3 comprising the amino acid sequence of SEQ ID NOs:141, 145, and 149, respectively;

a CDR-H1, CDR-H2, and CDR-H3 comprising the amino acid sequence of SEQ ID NOs:143, 147, and 153, respectively;

a CDR-H1, CDR-H2, and CDR-H3 comprising the amino acid sequence of SEQ ID NOs:144, 148, and 154, respectively;

a CDR-H1, CDR-H2, and CDR-H3 comprising the amino acid sequence of SEQ ID NOs:3, 6, and 155, respectively;

a CDR-H1, CDR-H2, and CDR-H3 comprising the amino acid sequence of SEQ ID NOs:2, 5, and 156, respectively;

a CDR-H1, CDR-H2, and CDR-H3 comprising the amino acid sequence of SEQ ID NOs:2, 5, and 157, respectively;

a CDR-H1, CDR-H2, and CDR-H3 comprising the amino acid sequence of SEQ ID NOs:2, 6, and 376, respectively;

a CDR-H1, CDR-H2, and CDR-H3 comprising the amino acid sequence of SEQ ID NOs:3, 6, and 155, respectively;

a CDR-H1, CDR-H2, and CDR-H3 comprising the amino acid sequence of SEQ ID NOs:3, 372, and 376, respectively;

a CDR-H1, CDR-H2, and CDR-H3 comprising the amino acid sequence of SEQ ID NOs:3, 6, and 376, respectively;

a CDR-H1, CDR-H2, and CDR-H3 comprising the amino acid sequence of SEQ ID NOs:593, 594, and 595, respectively;

a CDR-H1, CDR-H2, and CDR-H3 comprising the amino acid sequence of SEQ ID NOs:611, 612, and 613, respectively;

a CDR-H1, CDR-H2, and CDR-H3 comprising the amino acid sequence of SEQ ID NOs:507, 513, and 517, respectively;

a CDR-H1, CDR-H2, and CDR-H3 comprising the amino acid sequence of SEQ ID NOs:604, 605, and 606, respectively;

a CDR-H1, CDR-H2, and CDR-H3 comprising the amino acid sequence of SEQ ID NOs:288, 290, and 292, respectively; or a CDR-H1, CDR-H2, and CDR-H3 comprising the amino acid sequence of SEQ ID NOs:289, 291, and 293, respectively.

39. The polynucleotide of any of embodiments 30-38, wherein the $V_H$ region is or comprises the amino acid sequence set forth in any of SEQ ID NOs:110-115, 247-256, 324, 325, 518-531, 533, 609, 617, 772-774, or 814-832.

40. The polynucleotide of any of embodiments 30-39, wherein the $V_H$ region is or comprises the amino acid sequence set forth in any of SEQ ID NOs:110, 111, 112, 113, 115, 248, 252, 253, 254, 255, 256, 324, 325, 518, 519, 520, 521, 522, 609 or 617.

41. The polynucleotide of any of embodiments 30-40, wherein:

the $V_H$ region comprises a CDR-H1, CDR-H2, and CDR-H3 comprising the amino acid sequence of SEQ ID NOs: 593, 594, and 595, respectively; or the $V_H$ region comprises a CDR-H1, CDR-H2, and CDR-H3 comprising the amino acid sequence of SEQ ID NOs: 611, 612, and 613, respectively.

42. The polynucleotide of any of embodiments 30-41, wherein the $V_H$ region is or comprises the amino acid sequence set forth in SEQ ID NO:617.

43. The polynucleotide of any one of embodiments 30-42, wherein the $V_L$ region comprises a CDR-L1, CDR-L2, and CDR-L3 selected from:

a CDR-L1, CDR-L2, and CDR-L3 comprising the amino acid sequence of SEQ ID NOs:26, 37, and 47, respectively;

a CDR-L1, CDR-L2, and CDR-L3 comprising the amino acid sequence of SEQ ID NOs:27, 38, and 48, respectively;

a CDR-L1, CDR-L2, and CDR-L3 comprising the amino acid sequence of SEQ ID NOs:28, 39, and 49, respectively;

a CDR-L1, CDR-L2, and CDR-L3 comprising the amino acid sequence of SEQ ID NOs:29, 40, and 50, respectively;

a CDR-L1, CDR-L2, and CDR-L3 comprising the amino acid sequence of SEQ ID NOs:30, 39, and 51, respectively;

a CDR-L1, CDR-L2, and CDR-L3 comprising the amino acid sequence of SEQ ID NOs:31, 41, and 52, respectively;

a CDR-L1, CDR-L2, and CDR-L3 comprising the amino acid sequence of SEQ ID NOs:32, 42, and 53, respectively;

a CDR-L1, CDR-L2, and CDR-L3 comprising the amino acid sequence of SEQ ID NOs:30, 39, and 54, respectively;

a CDR-L1, CDR-L2, and CDR-L3 comprising the amino acid sequence of SEQ ID NOs:33, 43, and 55, respectively;

a CDR-L1, CDR-L2, and CDR-L3 comprising the amino acid sequence of SEQ ID NOs:34, 44, and 56, respectively;

a CDR-L1, CDR-L2, and CDR-L3 comprising the amino acid sequence of SEQ ID NOs:35, 45, and 57, respectively;

a CDR-L1, CDR-L2, and CDR-L3 comprising the amino acid sequence of SEQ ID NOs:36, 46, and 58, respectively;

a CDR-L1, CDR-L2, and CDR-L3 comprising the amino acid sequence of SEQ ID NOs:174, 179, and 184, respectively;

a CDR-L1, CDR-L2, and CDR-L3 comprising the amino acid sequence of SEQ ID NOs:174, 179, and 185, respectively;

a CDR-L1, CDR-L2, and CDR-L3 comprising the amino acid sequence of SEQ ID NOs:174, 179, and 186, respectively;

a CDR-L1, CDR-L2, and CDR-L3 comprising the amino acid sequence of SEQ ID NOs:174, 179, and 187, respectively;

a CDR-L1, CDR-L2, and CDR-L3 comprising the amino acid sequence of SEQ ID NOs:175, 180, and 188, respectively;

a CDR-L1, CDR-L2, and CDR-L3 comprising the amino acid sequence of SEQ ID NOs:174, 179, and 189, respectively;

a CDR-L1, CDR-L2, and CDR-L3 comprising the amino acid sequence of SEQ ID NOs:176, 181, and 190, respectively;

a CDR-L1, CDR-L2, and CDR-L3 comprising the amino acid sequence of SEQ ID NOs:177, 182, and 191, respectively;

a CDR-L1, CDR-L2, and CDR-L3 comprising the amino acid sequence of SEQ ID NOs:174, 179, and 192, respectively;

a CDR-L1, CDR-L2, and CDR-L3 comprising the amino acid sequence of SEQ ID NOs:178, 183, and 193, respectively;

a CDR-L1, CDR-L2, and CDR-L3 comprising the amino acid sequence of SEQ ID NOs:178, 183, and 194, respectively;

a CDR-L1, CDR-L2, and CDR-L3 comprising the amino acid sequence of SEQ ID NOs:30, 399, and 415, respectively;

a CDR-L1, CDR-L2, and CDR-L3 comprising the amino acid sequence of SEQ ID NOs:380, 400, and 416, respectively;

a CDR-L1, CDR-L2, and CDR-L3 comprising the amino acid sequence of SEQ ID NOs:33, 43, and 421, respectively;

a CDR-L1, CDR-L2, and CDR-L3 comprising the amino acid sequence of SEQ ID NOs:381, 401, and 417, respectively;

a CDR-L1, CDR-L2, and CDR-L3 comprising the amino acid sequence of SEQ ID NOs:382, 402, and 418, respectively;

a CDR-L1, CDR-L2, and CDR-L3 comprising the amino acid sequence of SEQ ID NOs:383, 403, and 419, respectively;

a CDR-L1, CDR-L2, and CDR-L3 comprising the amino acid sequence of SEQ ID NOs:384, 39, and 54, respectively;

a CDR-L1, CDR-L2, and CDR-L3 comprising the amino acid sequence of SEQ ID NOs:385, 180, and 58, respectively;

a CDR-L1, CDR-L2, and CDR-L3 comprising the amino acid sequence of SEQ ID NOs:175, 180, and 188, respectively;

a CDR-L1, CDR-L2, and CDR-L3 comprising the amino acid sequence of SEQ ID NOs:386, 404, and 420, respectively;

a CDR-L1, CDR-L2, and CDR-L3 comprising the amino acid sequence of SEQ ID NOs:387, 405, and 422, respectively;

a CDR-L1, CDR-L2, and CDR-L3 comprising the amino acid sequence of SEQ ID NOs:388, 406, and 423, respectively;

a CDR-L1, CDR-L2, and CDR-L3 comprising the amino acid sequence of SEQ ID NOs:388, 407, and 424, respectively;

a CDR-L1, CDR-L2, and CDR-L3 comprising the amino acid sequence of SEQ ID NOs:389, 408, and 425, respectively;

a CDR-L1, CDR-L2, and CDR-L3 comprising the amino acid sequence of SEQ ID NOs:390, 183, and 193, respectively;

a CDR-L1, CDR-L2, and CDR-L3 comprising the amino acid sequence of SEQ ID NOs:391, 409, and 426, respectively;

a CDR-L1, CDR-L2, and CDR-L3 comprising the amino acid sequence of SEQ ID NOs:392, 40, and 427, respectively;

a CDR-L1, CDR-L2, and CDR-L3 comprising the amino acid sequence of SEQ ID NOs:394, 39, and 429, respectively;

a CDR-L1, CDR-L2, and CDR-L3 comprising the amino acid sequence of SEQ ID NOs:395, 411, and 430, respectively;

a CDR-L1, CDR-L2, and CDR-L3 comprising the amino acid sequence of SEQ ID NOs:396, 412, and 431, respectively;

a CDR-L1, CDR-L2, and CDR-L3 comprising the amino acid sequence of SEQ ID NOs:396, 412, and 58, respectively;

a CDR-L1, CDR-L2, and CDR-L3 comprising the amino acid sequence of SEQ ID NOs:397, 413, and 432, respectively;

a CDR-L1, CDR-L2, and CDR-L3 comprising the amino acid sequence of SEQ ID NOs:398, 414, and 433, respectively;

a CDR-L1, CDR-L2, and CDR-L3 comprising the amino acid sequence of SEQ ID NOs:601, 602, and 603, respectively;

a CDR-L1, CDR-L2, and CDR-L3 comprising the amino acid sequence of SEQ ID NOs:614, 615, and 603, respectively;

a CDR-L1, CDR-L2, and CDR-L3 comprising the amino acid sequence of SEQ ID NOs:589, 590, and 591, respectively;

a CDR-L1, CDR-L2, and CDR-L3 comprising the amino acid sequence of SEQ ID NOs:607, 608, and 591, respectively;

a CDR-L1, CDR-L2, and CDR-L3 comprising the amino acid sequence of SEQ ID NOs: 302, 304, and 306, respectively; or a CDR-L1, CDR-L2, and CDR-L3 comprising the amino acid sequence of SEQ ID NOs:303, 305, and 307, respectively.

44. The polynucleotide of any one of embodiments 30-43, wherein the $V_L$ region comprises a CDR-L1, CDR-L2, and CDR-L3 selected from:

a CDR-L1, CDR-L2, and CDR-L3 comprising the amino acid sequence of SEQ ID NOs:26, 37, and 47, respectively;

a CDR-L1, CDR-L2, and CDR-L3 comprising the amino acid sequence of SEQ ID NOs:27, 38, and 48, respectively;

a CDR-L1, CDR-L2, and CDR-L3 comprising the amino acid sequence of SEQ ID NOs:28, 39, and 49, respectively;

a CDR-L1, CDR-L2, and CDR-L3 comprising the amino acid sequence of SEQ ID NOs:30, 39, and 51, respectively;

a CDR-L1, CDR-L2, and CDR-L3 comprising the amino acid sequence of SEQ ID NOs:31, 41, and 52, respectively;

a CDR-L1, CDR-L2, and CDR-L3 comprising the amino acid sequence of SEQ ID NOs:33, 43, and 55, respectively;

a CDR-L1, CDR-L2, and CDR-L3 comprising the amino acid sequence of SEQ ID NOs:34, 44, and 56, respectively;

a CDR-L1, CDR-L2, and CDR-L3 comprising the amino acid sequence of SEQ ID NOs:174, 179, and 185, respectively;

a CDR-L1, CDR-L2, and CDR-L3 comprising the amino acid sequence of SEQ ID NOs:174, 179, and 189, respectively;

a CDR-L1, CDR-L2, and CDR-L3 comprising the amino acid sequence of SEQ ID NOs:176, 181, and 190, respectively;

a CDR-L1, CDR-L2, and CDR-L3 comprising the amino acid sequence of SEQ ID NOs:177, 182, and 191, respectively;

a CDR-L1, CDR-L2, and CDR-L3 comprising the amino acid sequence of SEQ ID NOs:174, 179, and 192, respectively;

a CDR-L1, CDR-L2, and CDR-L3 comprising the amino acid sequence of SEQ ID NOs:178, 183, and 193, respectively;

a CDR-L1, CDR-L2, and CDR-L3 comprising the amino acid sequence of SEQ ID NOs:178, 183, and 194, respectively;

a CDR-L1, CDR-L2, and CDR-L3 comprising the amino acid sequence of SEQ ID NOs:30, 399, and 415, respectively;

a CDR-L1, CDR-L2, and CDR-L3 comprising the amino acid sequence of SEQ ID NOs:380, 400, and 416, respectively;

a CDR-L1, CDR-L2, and CDR-L3 comprising the amino acid sequence of SEQ ID NOs:33, 43, and 421, respectively;

a CDR-L1, CDR-L2, and CDR-L3 comprising the amino acid sequence of SEQ ID NOs:381, 401, and 417, respectively;

a CDR-L1, CDR-L2, and CDR-L3 comprising the amino acid sequence of SEQ ID NOs:382, 402, and 418, respectively;

a CDR-L1, CDR-L2, and CDR-L3 comprising the amino acid sequence of SEQ ID NOs:601, 602, and 603, respectively;

a CDR-L1, CDR-L2, and CDR-L3 comprising the amino acid sequence of SEQ ID NOs:614, 615, and 603, respectively;

a CDR-L1, CDR-L2, and CDR-L3 comprising the amino acid sequence of SEQ ID NOs:589, 590, and 591, respectively;

a CDR-L1, CDR-L2, and CDR-L3 comprising the amino acid sequence of SEQ ID NOs:607, 608, and 591, respectively;

a CDR-L1, CDR-L2, and CDR-L3 comprising the amino acid sequence of SEQ ID NOs: 302, 304, and 306, respectively; or a CDR-L1, CDR-L2, and CDR-L3 comprising the amino acid sequence of SEQ ID NOs:303, 305, and 307, respectively.

45. The polynucleotide of any of embodiments 30-44, wherein the $V_L$ region is or comprises the amino acid sequence set forth in any of SEQ ID NOs: 116-127, 257-267, 326, 327, 534-550, 552-557, 610, 618, 775-777, or 833-849.

46. The polynucleotide of any of embodiments 30-45, wherein the $V_L$ region is or comprises the amino acid sequence set forth in any of SEQ ID NOs: 116, 117, 118, 120, 121, 124, 125, 258, 262, 263, 264, 265, 266, 267, 326, 327, 534, 535, 536, 537, 538, 610 or 618.

47. The polynucleotide of any of embodiments 30-46, wherein:

the $V_L$ region comprises a CDR-L1, CDR-L2, and CDR-L3 comprising the amino acid sequence of SEQ ID NOs: 601, 602, and 603, respectively; or the $V_L$ region comprises a CDR-L1, CDR-L2, and CDR-L3 comprising the amino acid sequence of SEQ ID NOs: 614, 615, and 603, respectively.

48. The polynucleotide of any of embodiments 30-47, wherein the $V_L$ region is or comprises the amino acid sequence set forth in SEQ ID NO:618.

49. The polynucleotide of any of embodiments 30-48, wherein:

the $V_H$ region and the $V_L$ regions comprise the amino acid sequence set forth in SEQ ID NOs:110 and 116, respectively, or a sequence of amino acids that has at least 90% identity to SEQ ID NO:110 and 116, respectively;

the $V_H$ region and the $V_L$ regions comprise the amino acid sequence set forth in SEQ ID NOs:111 and 117, respectively, or a sequence of amino acids that has at least 90% identity to SEQ ID NO:111 and 117, respectively;

the $V_H$ region and the $V_L$ regions comprise the amino acid sequence set forth in SEQ ID NOs:110 and 118, respectively, or a sequence of amino acids that has at least 90% identity to SEQ ID NO:110 and 118, respectively;

the $V_H$ region and the $V_L$ regions comprise the amino acid sequence set forth in SEQ ID NOs:110 and 119, respectively, or a sequence of amino acids that has at least 90% identity to SEQ ID NO:110 and 119, respectively;

the $V_H$ region and the $V_L$ regions comprise the amino acid sequence set forth in SEQ ID NOs:110 and 120, respectively, or a sequence of amino acids that has at least 90% identity to SEQ ID NO:110 and 120, respectively;

the $V_H$ region and the $V_L$ regions comprise the amino acid sequence set forth in SEQ ID NOs:110 and 121, respectively, or a sequence of amino acids that has at least 90% identity to SEQ ID NO:110 and 121, respectively;

the $V_H$ region and the $V_L$ regions comprise the amino acid sequence set forth in SEQ ID NOs:110 and 122, respectively, or a sequence of amino acids that has at least 90% identity to SEQ ID NO:110 and 122, respectively;

the $V_H$ region and the $V_L$ regions comprise the amino acid sequence set forth in SEQ ID NOs:110 and 123, respectively, or a sequence of amino acids that has at least 90% identity to SEQ ID NO:110 and 123, respectively;

the $V_H$ region and the $V_L$ regions comprise the amino acid sequence set forth in SEQ ID NOs:112 and 124, respectively, or a sequence of amino acids that has at least 90% identity to SEQ ID NO:112 and 124, respectively;

the $V_H$ region and the $V_L$ regions comprise the amino acid sequence set forth in SEQ ID NOs:113 and 125, respectively, or a sequence of amino acids that has at least 90% identity to SEQ ID NO:113 and 125, respectively;

the $V_H$ region and the $V_L$ regions comprise the amino acid sequence set forth in SEQ ID NOs:114 and 126, respectively, or a sequence of amino acids that has at least 90% identity to SEQ ID NO:114 and 126, respectively;

the $V_H$ region and the $V_L$ regions comprise the amino acid sequence set forth in SEQ ID NOs:115 and 127, respectively, or a sequence of amino acids that has at least 90% identity to SEQ ID NO:115 and 127, respectively;

the $V_H$ region and the $V_L$ regions comprise the amino acid sequence set forth in SEQ ID NOs:247 and 257, respectively, or a sequence of amino acids that has at least 90% identity to SEQ ID NO:247 and 257, respectively;

the $V_H$ region and the $V_L$ regions comprise the amino acid sequence set forth in SEQ ID NOs:248 and 258, respectively, or a sequence of amino acids that has at least 90% identity to SEQ ID NO:248 and 258, respectively;

the $V_H$ region and the $V_L$ regions comprise the amino acid sequence set forth in SEQ ID NOs:249 and 259, respectively, or a sequence of amino acids that has at least 90% identity to SEQ ID NO:249 and 259, respectively;

the $V_H$ region and the $V_L$ regions comprise the amino acid sequence set forth in SEQ ID NOs:250 and 260, respectively, or a sequence of amino acids that has at least 90% identity to SEQ ID NO:250 and 260, respectively;

the $V_H$ region and the $V_L$ regions comprise the amino acid sequence set forth in SEQ ID NOs:251 and 261, respectively, or a sequence of amino acids that has at least 90% identity to SEQ ID NO:251 and 261, respectively;

the $V_H$ region and the $V_L$ regions comprise the amino acid sequence set forth in SEQ ID NOs:252 and 262, respectively, or a sequence of amino acids that has at least 90% identity to SEQ ID NO:252 and 262, respectively;

the $V_H$ region and the $V_L$ regions comprise the amino acid sequence set forth in SEQ ID NOs:253 and 263, respectively, or a sequence of amino acids that has at least 90% identity to SEQ ID NO:253 and 263, respectively;

the $V_H$ region and the $V_L$ regions comprise the amino acid sequence set forth in SEQ ID NOs:254 and 264, respectively, or a sequence of amino acids that has at least 90% identity to SEQ ID NO:254 and 264, respectively;

the $V_H$ region and the $V_L$ regions comprise the amino acid sequence set forth in SEQ ID NOs:255 and 265, respectively, or a sequence of amino acids that has at least 90% identity to SEQ ID NO:255 and 265, respectively;

the $V_H$ region and the $V_L$ regions comprise the amino acid sequence set forth in SEQ ID NOs:256 and 266, respectively, or a sequence of amino acids that has at least 90% identity to SEQ ID NO:256 and 266, respectively;

the $V_H$ region and the $V_L$ regions comprise the amino acid sequence set forth in SEQ ID NOs:256 and 267, respectively, or a sequence of amino acids that has at least 90% identity to SEQ ID NO:256 and 267, respectively;

the $V_H$ region and the $V_L$ regions comprise the amino acid sequence set forth in SEQ ID NOs:518 and 534, respectively, or a sequence of amino acids that has at least 90% identity to SEQ ID NO:518 and 534, respectively;

the $V_H$ region and the $V_L$ regions comprise the amino acid sequence set forth in SEQ ID NOs:519 and 535, respectively, or a sequence of amino acids that has at least 90% identity to SEQ ID NO:519 and 535, respectively;

the $V_H$ region and the $V_L$ regions comprise the amino acid sequence set forth in SEQ ID NOs:115 and 536, respecthe V$_H$ region and the V$_L$ regions comprise the amino acid sequence set forth in SEQ ID NOs:520 and 264, respectively, or a sequence of amino acids that has at least 90% identity to SEQ ID NO:520 and 264, respectively;

the V$_H$ region and the V$_L$ regions comprise the amino acid sequence set forth in SEQ ID NOs:521 and 537, respectively, or a sequence of amino acids that has at least 90% identity to SEQ ID NO:521 and 537, respectively;

the V$_H$ region and the V$_L$ regions comprise the amino acid sequence set forth in SEQ ID NOs:522 and 538, respectively, or a sequence of amino acids that has at least 90% identity to SEQ ID NO:522 and 538, respectively;

the V$_H$ region and the V$_L$ regions comprise the amino acid sequence set forth in SEQ ID NOs:523 and 539, respectively, or a sequence of amino acids that has at least 90% identity to SEQ ID NO:523 and 539, respectively;

the V$_H$ region and the V$_L$ regions comprise the amino acid sequence set forth in SEQ ID NOs:519 and 540, respectively, or a sequence of amino acids that has at least 90% identity to SEQ ID NO:519 and 540, respectively;

the V$_H$ region and the V$_L$ regions comprise the amino acid sequence set forth in SEQ ID NOs:524 and 541, respectively, or a sequence of amino acids that has at least 90% identity to SEQ ID NO:524 and 541, respectively;

the V$_H$ region and the V$_L$ regions comprise the amino acid sequence set forth in SEQ ID NOs:525 and 261, respectively, or a sequence of amino acids that has at least 90% identity to SEQ ID NO:525 and 261, respectively;

the V$_H$ region and the V$_L$ regions comprise the amino acid sequence set forth in SEQ ID NOs:526 and 542, respectively, or a sequence of amino acids that has at least 90% identity to SEQ ID NO:526 and 542, respectively;

the V$_H$ region and the V$_L$ regions comprise the amino acid sequence set forth in SEQ ID NOs:527 and 543, respectively, or a sequence of amino acids that has at least 90% identity to SEQ ID NO:527 and 543, respectively;

the V$_H$ region and the V$_L$ regions comprise the amino acid sequence set forth in SEQ ID NOs:528 and 544, respectively, or a sequence of amino acids that has at least 90% identity to SEQ ID NO:528 and 544, respectively;

the V$_H$ region and the V$_L$ regions comprise the amino acid sequence set forth in SEQ ID NOs:529 and 545, respectively, or a sequence of amino acids that has at least 90% identity to SEQ ID NO:529 and 545, respectively;

the V$_H$ region and the V$_L$ regions comprise the amino acid sequence set forth in SEQ ID NOs:528 and 546, respectively, or a sequence of amino acids that has at least 90% identity to SEQ ID NO:528 and 546, respectively;

the V$_H$ region and the V$_L$ regions comprise the amino acid sequence set forth in SEQ ID NOs:522 and 547, respectively, or a sequence of amino acids that has at least 90% identity to SEQ ID NO:522 and 547, respectively;

the V$_H$ region and the V$_L$ regions comprise the amino acid sequence set forth in SEQ ID NOs:256 and 548, respectively, or a sequence of amino acids that has at least 90% identity to SEQ ID NO:256 and 548, respectively;

the V$_H$ region and the V$_L$ regions comprise the amino acid sequence set forth in SEQ ID NOs:530 and 549, respectively, or a sequence of amino acids that has at least 90% identity to SEQ ID NO:530 and 549, respectively;

the V$_H$ region and the V$_L$ regions comprise the amino acid sequence set forth in SEQ ID NOs:531 and 550, respectively, or a sequence of amino acids that has at least 90% identity to SEQ ID NO:531 and 550, respectively;

the V$_H$ region and the V$_L$ regions comprise the amino acid sequence set forth in SEQ ID NOs:519 and 552, respectively, or a sequence of amino acids that has at least 90% identity to SEQ ID NO:519 and 552, respectively;

the V$_H$ region and the V$_L$ regions comprise the amino acid sequence set forth in SEQ ID NOs:110 and 553, respectively, or a sequence of amino acids that has at least 90% identity to SEQ ID NO:110 and 553, respectively;

the V$_H$ region and the V$_L$ regions comprise the amino acid sequence set forth in SEQ ID NOs:110 and 118, respectively, or a sequence of amino acids that has at least 90% identity to SEQ ID NO:110 and 118, respectively;

the V$_H$ region and the V$_L$ regions comprise the amino acid sequence set forth in SEQ ID NOs:533 and 554, respectively, or a sequence of amino acids that has at least 90% identity to SEQ ID NO:533 and 554, respectively;

the V$_H$ region and the V$_L$ regions comprise the amino acid sequence set forth in SEQ ID NOs:115 and 555, respectively, or a sequence of amino acids that has at least 90% identity to SEQ ID NO:115 and 555, respectively;

the V$_H$ region and the V$_L$ regions comprise the amino acid sequence set forth in SEQ ID NOs:524 and 556, respectively, or a sequence of amino acids that has at least 90% identity to SEQ ID NO:524 and 556, respectively;

the V$_H$ region and the V$_L$ regions comprise the amino acid sequence set forth in SEQ ID NOs:519 and 557, respectively, or a sequence of amino acids that has at least 90% identity to SEQ ID NO:519 and 557, respectively;

the V$_H$ region and the V$_L$ regions comprise the amino acid sequence set forth in SEQ ID NOs:609 and 610, respectively, or a sequence of amino acids that has at least 90% identity to SEQ ID NO:609 and 610, respectively;

the V$_H$ region and the V$_L$ regions comprise the amino acid sequence set forth in SEQ ID NOs:617 and 618, respectively, or a sequence of amino acids that has at least 90% identity to SEQ ID NO:617 and 618, respectively;

the V$_H$ region and the V$_L$ regions comprise the amino acid sequence set forth in SEQ ID NOs:324 and 326, respectively, or a sequence of amino acids that has at least 90% identity to SEQ ID NO:324 and 326, respectively; or the V$_H$ region and the V$_L$ regions comprise the amino acid sequence set forth in SEQ ID NOs:325 and 327, respectively, or a sequence of amino acids that has at least 90% identity to SEQ ID NO:325 and 327, respectively.

50. A polynucleotide of any of embodiments 30-49, wherein:

the V$_H$ region and the V$_L$ regions comprise the amino acid sequence set forth in SEQ ID NOs:110 and 116, respectively, or a sequence of amino acids that has at least 90% identity to SEQ ID NO:110 and 116, respectively;

the V$_H$ region and the V$_L$ regions comprise the amino acid sequence set forth in SEQ ID NOs:111 and 117, respectively, or a sequence of amino acids that has at least 90% identity to SEQ ID NO:111 and 117, respectively;

the V$_H$ region and the V$_L$ regions comprise the amino acid sequence set forth in SEQ ID NOs:110 and 118, respectively, or a sequence of amino acids that has at least 90% identity to SEQ ID NO:110 and 118, respectively;

the V$_H$ region and the V$_L$ regions comprise the amino acid sequence set forth in SEQ ID NOs:110 and 120, respectively, or a sequence of amino acids that has at least 90% identity to SEQ ID NO:110 and 120, respectively;

the V$_H$ region and the V$_L$ regions comprise the amino acid sequence set forth in SEQ ID NOs:110 and 121, respectively, or a sequence of amino acids that has at least 90% identity to SEQ ID NO:110 and 121, respectively;

the V$_H$ region and the V$_L$ regions comprise the amino acid sequence set forth in SEQ ID NOs:112 and 124, respectively, or a sequence of amino acids that has at least 90% identity to SEQ ID NO:112 and 124, respectively;

the V$_H$ region and the V$_L$ regions comprise the amino acid sequence set forth in SEQ ID NOs:113 and 125, respectively, or a sequence of amino acids that has at least 90% identity to SEQ ID NO:113 and 125, respectively;

the V$_H$ region and the V$_L$ regions comprise the amino acid sequence set forth in SEQ ID NOs:248 and 258, respectively, or a sequence of amino acids that has at least 90% identity to SEQ ID NO:248 and 258, respectively;

the V$_H$ region and the V$_L$ regions comprise the amino acid sequence set forth in SEQ ID NOs:252 and 262, respectively, or a sequence of amino acids that has at least 90% identity to SEQ ID NO:252 and 262, respectively;

the V$_H$ region and the V$_L$ regions comprise the amino acid sequence set forth in SEQ ID NOs:253 and 263, respectively, or a sequence of amino acids that has at least 90% identity to SEQ ID NO:253 and 263, respectively;

the V$_H$ region and the V$_L$ regions comprise the amino acid sequence set forth in SEQ ID NOs:254 and 264, respectively, or a sequence of amino acids that has at least 90% identity to SEQ ID NO:254 and 264, respectively;

the V$_H$ region and the V$_L$ regions comprise the amino acid sequence set forth in SEQ ID NOs:255 and 265, respectively, or a sequence of amino acids that has at least 90% identity to SEQ ID NO:255 and 265, respectively;

the V$_H$ region and the V$_L$ regions comprise the amino acid sequence set forth in SEQ ID NOs:256 and 266, respectively, or a sequence of amino acids that has at least 90% identity to SEQ ID NO:256 and 266, respectively;

the V$_H$ region and the V$_L$ regions comprise the amino acid sequence set forth in SEQ ID NOs:256 and 267, respectively, or a sequence of amino acids that has at least 90% identity to SEQ ID NO:256 and 267, respectively;

the V$_H$ region and the V$_L$ regions comprise the amino acid sequence set forth in SEQ ID NOs:518 and 534, respectively, or a sequence of amino acids that has at least 90% identity to SEQ ID NO:518 and 534, respectively;

the V$_H$ region and the V$_L$ regions comprise the amino acid sequence set forth in SEQ ID NOs:519 and 535, respectively, or a sequence of amino acids that has at least 90% identity to SEQ ID NO:519 and 535, respectively;

the V$_H$ region and the V$_L$ regions comprise the amino acid sequence set forth in SEQ ID NOs:115 and 536, respectively, or a sequence of amino acids that has at least 90% identity to SEQ ID NO:115 and 536, respectively;

the V$_H$ region and the V$_L$ regions comprise the amino acid sequence set forth in SEQ ID NOs:520 and 264, respectively, or a sequence of amino acids that has at least 90% identity to SEQ ID NO:520 and 264, respectively;

the V$_H$ region and the V$_L$ regions comprise the amino acid sequence set forth in SEQ ID NOs:521 and 537, respectively, or a sequence of amino acids that has at least 90% identity to SEQ ID NO:521 and 537, respectively;

the V$_H$ region and the V$_L$ regions comprise the amino acid sequence set forth in SEQ ID NOs:522 and 538, respectively, or a sequence of amino acids that has at least 90% identity to SEQ ID NO:522 and 538, respectively;

the V$_H$ region and the V$_L$ regions comprise the amino acid sequence set forth in SEQ ID NOs:609 and 610, respectively, or a sequence of amino acids that has at least 90% identity to SEQ ID NO:609 and 610, respectively;

the V$_H$ region and the V$_L$ regions comprise the amino acid sequence set forth in SEQ ID NOs:617 and 618, respectively, or a sequence of amino acids that has at least 90% identity to SEQ ID NO:617 and 618, respectively;

the V$_H$ region and the V$_L$ regions comprise the amino acid sequence set forth in SEQ ID NOs:324 and 326, respectively, or a sequence of amino acids that has at least 90% identity to SEQ ID NO:324 and 326, respectively; or the V$_H$ region and the V$_L$ regions comprise the amino acid sequence set forth in SEQ ID NOs:325 and 327, respectively, or a sequence of amino acids that has at least 90% identity to SEQ ID NO:325 and 327, respectively.

51. The polynucleotide of any of embodiments 30-50, wherein the fragment comprises an scFv.

52. The polynucleotide of any of embodiments 30-51, when the V$_H$ region and the V$_L$ region are joined by a flexible linker.

53. The polynucleotide of embodiment 52, wherein the scFv comprises a linker comprising the amino acid sequence GGGGSGGGGSGGGGS (SEQ ID NO:361).

54. The polynucleotide of any of embodiments 30-53, wherein the V$_H$ region is amino-terminal to the V$_L$ region.

55. The polynucleotide of any of embodiments 30-54, wherein the antigen-binding domain comprises the amino acid sequence selected from any one of SEQ ID NOs:128-139, 268-278, 329, 442, 478, 558-576, 578-583, 585, or 769-771 or an amino acid sequence having at least 90%, 91%, 92%, 93%, 94%, 95%, 96%, 97%, 98%, or 99% sequence identity to the amino acid sequence selected from any one of SEQ ID NOs: 128-139, 268-278, 329, 442, 478, 558-576, 578-583, 585, or 769-771.

56. The polynucleotide of any of embodiments 30-55, wherein the antigen-binding domain comprises the amino acid sequence selected from any one of SEQ ID NOs:128-130, 132, 133, 136, 137, 269, 273-278, 329, 442, 478, 558-563 or 585 or an amino acid sequence having at least 90%, 91%, 92%, 93%, 94%, 95%, 96%, 97%, 98%, or 99% sequence identity to the amino acid sequence selected from any one of SEQ ID NOs: 128-130, 132, 133, 136, 137, 269, 273-278, 329, 442, 478, 558-563 or 585.

57. The polynucleotide of any of embodiments 30-56, wherein the nucleic acid encoding the antigen-binding domain comprises (a) the sequence of nucleotides set forth in any of SEQ ID NOS: 330-352, 647, 648, 716 or 718; (b) a sequence of nucleotides that has at least 90% sequence identity to any of SEQ ID NOS: 330-352, 647, 648, 716 or 718; or (c) a degenerate sequence of (a) or (b).

58. The polynucleotide of any of embodiments 30-57, wherein the nucleic acid encoding the antigen-binding domain comprises (a) the sequence of nucleotides set forth in any of SEQ ID NOS: 352, 647, 648, 716, or 718; (b) a sequence of nucleotides that has at least 90% sequence identity to any of SEQ ID NOS: 352, 647, 648, 716, or 718; or (c) a degenerate sequence of (a) or (b).

59. The polynucleotide of any of embodiments 30-57, wherein the nucleic acid encoding the antigen-binding domain is codon-optimized.

60. The polynucleotide of any of embodiments 30-57, wherein the nucleic acid encoding the antigen-binding domain comprises the sequence of nucleotides set forth in any of SEQ ID NO: 440, 460, 715, 717 or 719.

61. The polynucleotide of any of embodiments 30-60, wherein the nucleic acid encoding the antigen-binding domain comprises the sequence of nucleotides set forth in SEQ ID NO:460.

62. The polynucleotide of any of embodiments 30-53, wherein the V$_H$ region is carboxy-terminal to the V$_L$ region.

63. The polynucleotide of any of embodiments 51-53 and 62, wherein the scFv comprises the amino acid sequence set forth in SEQ ID NOs:328 or 586, or an amino acid sequence having at least 90%, 91%, 92%, 93%, 94%, 95%, 96%, 97%, 98%, or 99% sequence identity to the amino acid sequence set forth in SEQ ID NO:328 or 586.

64. The polynucleotide of any of embodiments 1-59, wherein the intracellular signaling region comprises an activating cytoplasmic signaling domain.

65. The polynucleotide of embodiment 60, wherein the activating cytoplasmic signaling domain is capable of inducing a primary activation signal in a T cell, is a T cell receptor (TCR) component and/or comprises an immunoreceptor tyrosine-based activation motif (ITAM).

66. The polynucleotide of embodiment 64 or embodiment 65, wherein the activating cytoplasmic signaling domain is or comprises a cytoplasmic signaling domain of a zeta chain of a CD3-zeta (CD3ζ) chain or a functional variant or signaling portion thereof.

67. The polynucleotide of any of embodiments 64-66, wherein the activating cytoplasmic domain is human or is derived from a human protein.

68. The polynucleotide of any of embodiments 64-67, wherein the activating cytoplasmic domain is or comprises the sequence set forth in SEQ ID NO:628 or a sequence of amino acids that has at least 90% sequence identity to SEQ ID NO:628.

69. The polynucleotide of any of embodiments 64-68, wherein the nucleic acid encoding the activating cytoplasmic domain is or comprises the sequence set forth in SEQ ID NO:627 or is a codon-optimized sequence and/or degenerate sequence thereof.

70. The polynucleotide of any of embodiments 64-69, wherein the nucleic acid encoding the activating cytoplasmic signaling domain is or comprises the sequence set forth in SEQ ID NO:652.

71. The polynucleotide of any of embodiments 64-70, wherein the intracellular signaling region further comprises a costimulatory signaling region.

72. The polynucleotide of embodiment 71, wherein the costimulatory signaling region comprises an intracellular signaling domain of a T cell costimulatory molecule or a signaling portion thereof.

73. The polynucleotide of embodiment 71 or embodiment 72, wherein the costimulatory signaling region comprises an intracellular signaling domain of a CD28, a 4-1BB or an ICOS or a signaling portion thereof.

74. The polynucleotide of any of embodiments 71-73, wherein the costimulatory signaling region comprises an intracellular signaling domain of 4-1BB.

75. The polynucleotide of any of embodiments 71-74, wherein the costimulatory signaling region is human or is derived from a human protein.

76. The polynucleotide of any of embodiments 71-75, wherein the costimulatory signaling region is or comprises the sequence set forth in SEQ ID NO:626 or a sequence of amino acids that exhibits at least 90% sequence identity to the sequence set forth in SEQ ID NO: 626.

77. The polynucleotide of any of embodiments 71-76, wherein the nucleic acid encoding the costimulatory region is or comprises the sequence set forth in SEQ ID NO:625 or is a codon-optimized sequence and/or degenerate sequence thereof.

78. The polynucleotide of any of embodiments 71-77, wherein the nucleic acid encoding the costimulatory signaling region comprises the sequence set forth in SEQ ID NO:681.

79. The polynucleotide of any of embodiments 71-78, wherein the costimulatory signaling region is between the transmembrane domain and the intracellular signaling region.

80. The polynucleotide of any of embodiments 1-79, wherein the transmembrane domain is or comprises a transmembrane domain derived from CD4, CD28, or CD8.

81. The polynucleotide of embodiment 80, wherein the transmembrane domain is or comprises a transmembrane domain derived from a CD28.

82. The polynucleotide of any of embodiments 1-81, wherein the transmembrane domain is human or is derived from a human protein.

83. The polynucleotide of any of embodiments 1-82, wherein the transmembrane domain is or comprises the sequence set forth in SEQ ID NO:624 or a sequence of amino acids that exhibits at least 90% sequence identity to SEQ ID NO:624.

84. The polynucleotide of any of embodiments 1-83, wherein the nucleic acid encoding the transmembrane domain is or comprises the sequence set forth in SEQ ID NO:623 or is a codon-optimized sequence and/or degenerate sequence thereof.

85. The polynucleotide of embodiment 35a, wherein the nucleic acid encoding the transmembrane domain comprises the sequence set forth in SEQ ID NO:688.

86. The polynucleotide of any of embodiments 1-85, wherein the encoded chimeric antigen receptor comprises from its N to C terminus in order: the antigen-binding domain, the spacer, the transmembrane domain and the intracellular signaling domain.

87. The polynucleotide of any of embodiments 1-86, wherein the polynucleotide further encodes a truncated receptor 88. A chimeric antigen receptor encoded by the polynucleotide of any of embodiments 1-87.

89. A chimeric antigen receptor comprising: (a) an extracellular antigen-binding domain that specifically recognizes B cell maturation antigen (BCMA); (b) a spacer of at least 125 amino acids in length; (c) a transmembrane domain; and (d) an intracellular signaling region.

90. The chimeric antigen receptor of embodiment 89, wherein the spacer is derived from an immunoglobulin.

91. The chimeric antigen receptor of embodiment 89 or embodiment 90, wherein the spacer comprises a sequence of a hinge region, a $C_H2$ and $C_H3$ region.

92. The chimeric antigen receptor of embodiment 91, wherein one of more of the hinge, $C_H2$ and $C_H3$ is derived all or in part from IgG4 or IgG2, optionally human IgG4 or human IgG2.

93. The chimeric antigen receptor of embodiment 90 or embodiment 91, wherein the hinge, $C_H2$ and $C_H3$ is derived from IgG4.

94. The chimeric antigen receptor of embodiment 90 or embodiment 91, wherein one or more of the hinge, $C_H2$ and $C_H3$ is chimeric and comprises sequence derived from IgG4 and IgG2.

95. The chimeric antigen receptor of embodiment 94, wherein the spacer comprises an IgG4/2 chimeric hinge or a modified IgG4 comprising at least one amino acid replacement compared to human IgG4, an IgG2/4 chimeric $C_H2$, and an IgG4 $C_H3$ region.

96. The chimeric antigen receptor of any of embodiments 89-92 and 94-95, wherein the spacer is or comprises (i) the sequence set forth in SEQ ID NO: 649; (ii) a functional variant of SEQ ID NO:649 that has at least 95%, 96%, 97%, 98% or 99% sequence identity to SEQ ID NO:649; or (iii) a contiguous portion of (i) or (ii) that is at least 125 amino acids in length.

97. The chimeric antigen receptor of any of embodiments 89-92 and 94-96, wherein the encoded spacer is or comprises the sequence set forth in SEQ ID NO: 649.

98. A chimeric antigen receptor comprising: (a) an extracellular antigen-binding domain that specifically recognizes B cell maturation antigen (BCMA); (b) a spacer set forth in SEQ ID NO:649; (c) a transmembrane domain; and (d) an intracellular signaling region.

99. The chimeric antigen receptor of any of embodiments 89-98, wherein the antigen-binding domain is an antibody fragment comprising a variable heavy chain ($V_H$) and a variable light chain ($V_L$) region.

100. The chimeric antigen receptor of embodiment 99, wherein:
the $V_H$ region is or comprises an amino acid sequence having at least 90%, 91%, 92%, 93%, 94%, 95%, 96%, 97%, 98% or 99% sequence identity to the $V_H$ region amino acid sequence set forth in any of SEQ ID NOs:110-115, 247-256, 324, 325, 518-531, 533, 609 or 617; and/or
the $V_L$ region is or comprises an amino acid sequence having at least 90%, 91%, 92%, 93%, 94%, 95%, 96%, 97%, 98%, or 99% sequence identity to the $V_L$ region amino acid sequence set forth in any of SEQ ID NOs:116-127, 257-267, 326, 327, 534-550, 552-557, 610, 618, 775-777, or 833-849.

101. The chimeric antigen receptor of embodiment 99 or embodiment 100, wherein:
the $V_H$ region is or comprises an amino acid sequence having at least 90%, 91%, 92%, 93%, 94%, 95%, 96%, 97%, 98% or 99% sequence identity to the $V_H$ region amino acid sequence set forth in any of SEQ ID NOs: 110, 111, 112, 113, 115, 248, 252, 253, 254, 255, 256, 324, 325, 518, 519, 520, 521, 522, 609 or 617; and/or
the $V_L$ region is or comprises an amino acid sequence having at least 90%, 91%, 92%, 93%, 94%, 95%, 96%, 97%, 98%, or 99% sequence identity to the $V_L$ region amino acid sequence set forth in any of SEQ ID NOs: 116, 117, 118, 120, 121, 124, 125, 258, 262, 263, 264, 265, 266, 267, 326, 327, 534, 535, 536, 537, 538, 610 or 618.

102. The chimeric antigen receptor of embodiment 99 or embodiment 100, wherein:
the $V_H$ region is or comprises a CDR-H1, CDR-H2 and CDR-H3 contained within the $V_H$ region amino acid sequence selected from any one of SEQ ID NOs:110-115, 247-256, 324, 325, 518-531, 533, 609, 617, 772-774, or 814-832; and/or
the $V_L$ region is or comprises a CDR-L1, CDR-L2 and CDR-L3 contained within the $V_L$ region amino acid sequence selected from any one of SEQ ID NOs:116-127, 257-267, 326, 327, 534-550, 552-557, 610, 618, 775-777, or 833-849.

103. The chimeric antigen receptor of any of embodiments 99-102, wherein:
the $V_H$ region is or comprises a CDR-H1, CDR-H2 and CDR-H3 contained within the $V_H$ region amino acid sequence selected from any one of SEQ ID NOs: 110, 111, 112, 113, 115, 248, 252, 253, 254, 255, 256, 324, 325, 518, 519, 520, 521, 522, 609 or 617; and/or
the $V_L$ region is or comprises a CDR-L1, CDR-L2 and CDR-L3 contained within the $V_L$ region amino acid sequence selected from any one of SEQ ID NOs: 116, 117, 118, 120, 121, 124, 125, 258, 262, 263, 264, 265, 266, 267, 326, 327, 534, 535, 536, 537, 538, 610 or 618.

104. The chimeric antigen receptor of any of embodiments 99-103, wherein:
the $V_H$ region is or comprises (a) a heavy chain complementarity determining region 1 (CDR-H1) comprising the amino acid sequence selected from any one of SEQ ID NOs:1-3, 140-144, 288, 289, 294, 295, 507, 532, 593, 596, 604, 611; and/or (b) a heavy chain complementarity determining region 2 (CDR-H2) comprising the amino acid sequence selected from any one of SEQ ID NOs:4-6, 145-148, 290, 291, 296, 297, 372-374, 513, 551, 594, 597, 605, 612; and (c) a heavy chain complementarity determining region 3 (CDR-H3) comprising the amino acid sequence selected from any one of SEQ ID NOs:7-11, 149-157, 279-287, 292, 293, 376-378, 517, 595, 606, 613; and/or
the $V_L$ region is or comprises (a) a light chain complementarity determining region 1 (CDR-L1) comprising the amino acid sequence selected from any one of SEQ ID NOs:26-36, 174-178, 302, 303, 380-392, 394-398, 589, 601, 607 or 614; (b) a light chain complementarity determining region 2 (CDR-L2) comprising the amino acid sequence selected from any one of SEQ ID NOs:37-46, 179-183, 304, 305, 399-409, 411-414, 590, 602, 608 or 615; and (c) a light chain complementarity determining region 3 (CDR-L3) comprising the amino acid sequence selected from any one of SEQ ID NOs:47-58, 184-194, 306, 307, 415-427, 429-433, 591, or 603.

105. The chimeric antigen receptor of any of embodiments 99-104, wherein:
the $V_H$ region is or comprises (a) a heavy chain complementarity determining region 1 (CDR-H1) comprising the amino acid sequence selected from any one of SEQ ID NOs: 1, 2, 3, 141, 143, 144, 288, 289, 507, 593, 604, 611; and/or (b) a heavy chain complementarity determining region 2 (CDR-H2) comprising the amino acid sequence selected from any one of SEQ ID NOs: 4, 5, 6, 145, 147, 148, 290, 291, 372, 513, 594, 605 or 612; and (c) a heavy chain complementarity determining region 3 (CDR-H3) comprising the amino acid sequence selected from any one of SEQ ID NOs: 7, 8, 9, 10, 149, 153, 154, 155, 156, 157, 292, 293, 376, 517, 595, 606 or 613; and/or
the $V_L$ region is or comprises (a) a light chain complementarity determining region 1 (CDR-L1) comprising the amino acid sequence selected from any one of SEQ ID NOs: 26, 27, 28, 30, 31, 33, 34, 174, 176, 177, 178, 302, 303, 380, 381, 382, 589, 601, 607 or 614; (b) a light chain complementarity determining region 2 (CDR-L2) comprising the amino acid sequence selected from any one of SEQ ID NOs: 37, 38, 39, 41, 43, 44, 179, 181, 182, 183, 304, 305, 399, 400, 401, 402, 590, 602, 608 or 615; and (c) a light chain complementarity determining region 3 (CDR-L3) comprising the amino acid sequence selected from any one of SEQ ID NOs: 47, 48, 49, 51, 52, 55, 56, 185, 189, 190, 191, 192, 193, 194, 306, 307, 415, 417, 418, 421, 591, or 603.

106. The chimeric antigen receptor of any of embodiments 99-105, wherein the $V_H$ region comprises a CDR-H1, CDR-H2, and CDR-H3, selected from:
a CDR-H1, CDR-H2, and CDR-H3 comprising the amino acid sequence of SEQ ID NOs:1, 4, and 7, respectively;
a CDR-H1, CDR-H2, and CDR-H3 comprising the amino acid sequence of SEQ ID NOs:2, 5, and 8, respectively;
a CDR-H1, CDR-H2, and CDR-H3 comprising the amino acid sequence of SEQ ID NOs:2, 5, and 9, respectively;
a CDR-H1, CDR-H2, and CDR-H3 comprising the amino acid sequence of SEQ ID NOs:2, 5, and 10, respectively;
a CDR-H1, CDR-H2, and CDR-H3 comprising the amino acid sequence of SEQ ID NOs:3, 6, and 11, respectively;
a CDR-H1, CDR-H2, and CDR-H3 comprising the amino acid sequence of SEQ ID NOs:140, 145, and 149, respectively;

a CDR-H1, CDR-H2, and CDR-H3 comprising the amino acid sequence of SEQ ID NOs:141, 145, and 149, respectively;
a CDR-H1, CDR-H2, and CDR-H3 comprising the amino acid sequence of SEQ ID NOs:141, 145, and 150, respectively;
a CDR-H1, CDR-H2, and CDR-H3 comprising the amino acid sequence of SEQ ID NOs:142, 146, and 151, respectively;
a CDR-H1, CDR-H2, and CDR-H3 comprising the amino acid sequence of SEQ ID NOs:2, 5, and 152, respectively;
a CDR-H1, CDR-H2, and CDR-H3 comprising the amino acid sequence of SEQ ID NOs:143, 147, and 153, respectively;
a CDR-H1, CDR-H2, and CDR-H3 comprising the amino acid sequence of SEQ ID NOs:144, 148, and 154, respectively;
a CDR-H1, CDR-H2, and CDR-H3 comprising the amino acid sequence of SEQ ID NOs:3, 6, and 155, respectively;
a CDR-H1, CDR-H2, and CDR-H3 comprising the amino acid sequence of SEQ ID NOs:2, 5, and 156, respectively;
a CDR-H1, CDR-H2, and CDR-H3 comprising the amino acid sequence of SEQ ID NOs:2, 5, and 157, respectively;
a CDR-H1, CDR-H2, and CDR-H3 comprising the amino acid sequence of SEQ ID NOs:2, 6, and 376, respectively;
a CDR-H1, CDR-H2, and CDR-H3 comprising the amino acid sequence of SEQ ID NOs:3, 6, and 155, respectively;
a CDR-H1, CDR-H2, and CDR-H3 comprising the amino acid sequence of SEQ ID NOs:3, 372, and 376, respectively;
a CDR-H1, CDR-H2, and CDR-H3 comprising the amino acid sequence of SEQ ID NOs:3, 6, and 376, respectively;
a CDR-H1, CDR-H2, and CDR-H3 comprising the amino acid sequence of SEQ ID NOs:3, 6, and 377, respectively;
a CDR-H1, CDR-H2, and CDR-H3 comprising the amino acid sequence of SEQ ID NOs:2, 373, and 152, respectively;
a CDR-H1, CDR-H2, and CDR-H3 comprising the amino acid sequence of SEQ ID NOs:2, 5, and 378, respectively;
a CDR-H1, CDR-H2, and CDR-H3 comprising the amino acid sequence of SEQ ID NOs:2, 374, and 9, respectively;
a CDR-H1, CDR-H2, and CDR-H3 comprising the amino acid sequence of SEQ ID NOs:593, 594, and 595, respectively;
a CDR-H1, CDR-H2, and CDR-H3 comprising the amino acid sequence of SEQ ID NOs:611, 612, and 613, respectively;
a CDR-H1, CDR-H2, and CDR-H3 comprising the amino acid sequence of SEQ ID NOs:507, 513, and 517, respectively;
a CDR-H1, CDR-H2, and CDR-H3 comprising the amino acid sequence of SEQ ID NOs:604, 605, and 606, respectively;
a CDR-H1, CDR-H2, and CDR-H3 comprising the amino acid sequence of SEQ ID NOs:288, 290, and 292, respectively; or
a CDR-H1, CDR-H2, and CDR-H3 comprising the amino acid sequence of SEQ ID NOs:289, 291, and 293, respectively.

107. The chimeric antigen receptor of any of embodiments 99-106, wherein the $V_H$ region comprises a CDR-H1, CDR-H2, and CDR-H3, selected from:
a CDR-H1, CDR-H2, and CDR-H3 comprising the amino acid sequence of SEQ ID NOs:1, 4, and 7, respectively;
a CDR-H1, CDR-H2, and CDR-H3 comprising the amino acid sequence of SEQ ID NOs:2, 5, and 8, respectively;
a CDR-H1, CDR-H2, and CDR-H3 comprising the amino acid sequence of SEQ ID NOs:2, 5, and 9, respectively;
a CDR-H1, CDR-H2, and CDR-H3 comprising the amino acid sequence of SEQ ID NOs:2, 5, and 10, respectively;
a CDR-H1, CDR-H2, and CDR-H3 comprising the amino acid sequence of SEQ ID NOs:141, 145, and 149, respectively;
a CDR-H1, CDR-H2, and CDR-H3 comprising the amino acid sequence of SEQ ID NOs:143, 147, and 153, respectively;
a CDR-H1, CDR-H2, and CDR-H3 comprising the amino acid sequence of SEQ ID NOs:144, 148, and 154, respectively;
a CDR-H1, CDR-H2, and CDR-H3 comprising the amino acid sequence of SEQ ID NOs:3, 6, and 155, respectively;
a CDR-H1, CDR-H2, and CDR-H3 comprising the amino acid sequence of SEQ ID NOs:2, 5, and 156, respectively;
a CDR-H1, CDR-H2, and CDR-H3 comprising the amino acid sequence of SEQ ID NOs:2, 5, and 157, respectively;
a CDR-H1, CDR-H2, and CDR-H3 comprising the amino acid sequence of SEQ ID NOs:2, 6, and 376, respectively;
a CDR-H1, CDR-H2, and CDR-H3 comprising the amino acid sequence of SEQ ID NOs:3, 6, and 155, respectively;
a CDR-H1, CDR-H2, and CDR-H3 comprising the amino acid sequence of SEQ ID NOs:3, 372, and 376, respectively;
a CDR-H1, CDR-H2, and CDR-H3 comprising the amino acid sequence of SEQ ID NOs:3, 6, and 376, respectively;
a CDR-H1, CDR-H2, and CDR-H3 comprising the amino acid sequence of SEQ ID NOs:593, 594, and 595, respectively;
a CDR-H1, CDR-H2, and CDR-H3 comprising the amino acid sequence of SEQ ID NOs:611, 612, and 613, respectively;
a CDR-H1, CDR-H2, and CDR-H3 comprising the amino acid sequence of SEQ ID NOs:507, 513, and 517, respectively;
a CDR-H1, CDR-H2, and CDR-H3 comprising the amino acid sequence of SEQ ID NOs:604, 605, and 606, respectively;
a CDR-H1, CDR-H2, and CDR-H3 comprising the amino acid sequence of SEQ ID NOs:288, 290, and 292, respectively; or
a CDR-H1, CDR-H2, and CDR-H3 comprising the amino acid sequence of SEQ ID NOs:289, 291, and 293, respectively.

108. The chimeric antigen receptor of any of embodiments 99-107, wherein the $V_H$ region is or comprises the amino acid sequence set forth in any of SEQ ID NOs:110-115, 247-256, 324, 325, 518-531, 533, 609, 617, 772-774, or 814-832.

109. The chimeric antigen receptor of any of embodiments 99-108, wherein the $V_H$ region is or comprises the amino acid sequence set forth in any of SEQ ID NOs:110, 111, 112, 113, 115, 248, 252, 253, 254, 255, 256, 324, 325, 518, 519, 520, 521, 522, 609 or 617.

110. The chimeric antigen receptor of any of embodiments 99-109 wherein:
the $V_H$ region comprises a CDR-H1, CDR-H2, and CDR-H3 comprising the amino acid sequence of SEQ ID NOs: 593, 594, and 595, respectively; or
the $V_H$ region comprises a CDR-H1, CDR-H2, and CDR-H3 comprising the amino acid sequence of SEQ ID NOs: 611, 612, and 613, respectively;

111. The chimeric antigen receptor of any of embodiments 99-110, wherein the $V_H$ region is or comprises the amino acid sequence set forth in SEQ ID NO:617.

112. The chimeric antigen receptor of any one of embodiments 99-111, wherein the $V_L$ region comprises a CDR-L1, CDR-L2, and CDR-L3 selected from:

a CDR-L1, CDR-L2, and CDR-L3 comprising the amino acid sequence of SEQ ID NOs:26, 37, and 47, respectively;

a CDR-L1, CDR-L2, and CDR-L3 comprising the amino acid sequence of SEQ ID NOs:27, 38, and 48, respectively;

a CDR-L1, CDR-L2, and CDR-L3 comprising the amino acid sequence of SEQ ID NOs:28, 39, and 49, respectively;

a CDR-L1, CDR-L2, and CDR-L3 comprising the amino acid sequence of SEQ ID NOs:29, 40, and 50, respectively;

a CDR-L1, CDR-L2, and CDR-L3 comprising the amino acid sequence of SEQ ID NOs:30, 39, and 51, respectively;

a CDR-L1, CDR-L2, and CDR-L3 comprising the amino acid sequence of SEQ ID NOs:31, 41, and 52, respectively;

a CDR-L1, CDR-L2, and CDR-L3 comprising the amino acid sequence of SEQ ID NOs:32, 42, and 53, respectively;

a CDR-L1, CDR-L2, and CDR-L3 comprising the amino acid sequence of SEQ ID NOs:30, 39, and 54, respectively;

a CDR-L1, CDR-L2, and CDR-L3 comprising the amino acid sequence of SEQ ID NOs:33, 43, and 55, respectively;

a CDR-L1, CDR-L2, and CDR-L3 comprising the amino acid sequence of SEQ ID NOs:34, 44, and 56, respectively;

a CDR-L1, CDR-L2, and CDR-L3 comprising the amino acid sequence of SEQ ID NOs:35, 45, and 57, respectively;

a CDR-L1, CDR-L2, and CDR-L3 comprising the amino acid sequence of SEQ ID NOs:36, 46, and 58, respectively;

a CDR-L1, CDR-L2, and CDR-L3 comprising the amino acid sequence of SEQ ID NOs:174, 179, and 184, respectively;

a CDR-L1, CDR-L2, and CDR-L3 comprising the amino acid sequence of SEQ ID NOs:174, 179, and 185, respectively;

a CDR-L1, CDR-L2, and CDR-L3 comprising the amino acid sequence of SEQ ID NOs:174, 179, and 186, respectively;

a CDR-L1, CDR-L2, and CDR-L3 comprising the amino acid sequence of SEQ ID NOs:174, 179, and 187, respectively;

a CDR-L1, CDR-L2, and CDR-L3 comprising the amino acid sequence of SEQ ID NOs:175, 180, and 188, respectively;

a CDR-L1, CDR-L2, and CDR-L3 comprising the amino acid sequence of SEQ ID NOs:174, 179, and 189, respectively;

a CDR-L1, CDR-L2, and CDR-L3 comprising the amino acid sequence of SEQ ID NOs:176, 181, and 190, respectively;

a CDR-L1, CDR-L2, and CDR-L3 comprising the amino acid sequence of SEQ ID NOs:177, 182, and 191, respectively;

a CDR-L1, CDR-L2, and CDR-L3 comprising the amino acid sequence of SEQ ID NOs:174, 179, and 192, respectively;

a CDR-L1, CDR-L2, and CDR-L3 comprising the amino acid sequence of SEQ ID NOs:178, 183, and 193, respectively;

a CDR-L1, CDR-L2, and CDR-L3 comprising the amino acid sequence of SEQ ID NOs:178, 183, and 194, respectively;

a CDR-L1, CDR-L2, and CDR-L3 comprising the amino acid sequence of SEQ ID NOs:30, 399, and 415, respectively;

a CDR-L1, CDR-L2, and CDR-L3 comprising the amino acid sequence of SEQ ID NOs:380, 400, and 416, respectively;

a CDR-L1, CDR-L2, and CDR-L3 comprising the amino acid sequence of SEQ ID NOs:33, 43, and 421, respectively;

a CDR-L1, CDR-L2, and CDR-L3 comprising the amino acid sequence of SEQ ID NOs:381, 401, and 417, respectively;

a CDR-L1, CDR-L2, and CDR-L3 comprising the amino acid sequence of SEQ ID NOs:382, 402, and 418, respectively;

a CDR-L1, CDR-L2, and CDR-L3 comprising the amino acid sequence of SEQ ID NOs:383, 403, and 419, respectively;

a CDR-L1, CDR-L2, and CDR-L3 comprising the amino acid sequence of SEQ ID NOs:384, 39, and 54, respectively;

a CDR-L1, CDR-L2, and CDR-L3 comprising the amino acid sequence of SEQ ID NOs:385, 180, and 58, respectively;

a CDR-L1, CDR-L2, and CDR-L3 comprising the amino acid sequence of SEQ ID NOs:175, 180, and 188, respectively;

a CDR-L1, CDR-L2, and CDR-L3 comprising the amino acid sequence of SEQ ID NOs:386, 404, and 420, respectively;

a CDR-L1, CDR-L2, and CDR-L3 comprising the amino acid sequence of SEQ ID NOs:387, 405, and 422, respectively;

a CDR-L1, CDR-L2, and CDR-L3 comprising the amino acid sequence of SEQ ID NOs:388, 406, and 423, respectively;

a CDR-L1, CDR-L2, and CDR-L3 comprising the amino acid sequence of SEQ ID NOs:388, 407, and 424, respectively;

a CDR-L1, CDR-L2, and CDR-L3 comprising the amino acid sequence of SEQ ID NOs:389, 408, and 425, respectively;

a CDR-L1, CDR-L2, and CDR-L3 comprising the amino acid sequence of SEQ ID NOs:390, 183, and 193, respectively;

a CDR-L1, CDR-L2, and CDR-L3 comprising the amino acid sequence of SEQ ID NOs:391, 409, and 426, respectively;

a CDR-L1, CDR-L2, and CDR-L3 comprising the amino acid sequence of SEQ ID NOs:392, 40, and 427, respectively;

a CDR-L1, CDR-L2, and CDR-L3 comprising the amino acid sequence of SEQ ID NOs:394, 39, and 429, respectively;

a CDR-L1, CDR-L2, and CDR-L3 comprising the amino acid sequence of SEQ ID NOs:395, 411, and 430, respectively;

a CDR-L1, CDR-L2, and CDR-L3 comprising the amino acid sequence of SEQ ID NOs:396, 412, and 431, respectively;

a CDR-L1, CDR-L2, and CDR-L3 comprising the amino acid sequence of SEQ ID NOs:396, 412, and 58, respectively;

a CDR-L1, CDR-L2, and CDR-L3 comprising the amino acid sequence of SEQ ID NOs:397, 413, and 432, respectively;

a CDR-L1, CDR-L2, and CDR-L3 comprising the amino acid sequence of SEQ ID NOs:398, 414, and 433, respectively;

a CDR-L1, CDR-L2, and CDR-L3 comprising the amino acid sequence of SEQ ID NOs:601, 602, and 603, respectively;

a CDR-L1, CDR-L2, and CDR-L3 comprising the amino acid sequence of SEQ ID NOs:614, 615, and 603, respectively;

a CDR-L1, CDR-L2, and CDR-L3 comprising the amino acid sequence of SEQ ID NOs:589, 590, and 591, respectively;

a CDR-L1, CDR-L2, and CDR-L3 comprising the amino acid sequence of SEQ ID NOs:607, 608, and 591, respectively;

a CDR-L1, CDR-L2, and CDR-L3 comprising the amino acid sequence of SEQ ID NOs: 302, 304, and 306, respectively; or a CDR-L1, CDR-L2, and CDR-L3 comprising the amino acid sequence of SEQ ID NOs:303, 305, and 307, respectively.

113. The chimeric antigen receptor of any one of embodiments 99-112, wherein the $V_L$ region comprises a CDR-L1, CDR-L2, and CDR-L3 selected from:

a CDR-L1, CDR-L2, and CDR-L3 comprising the amino acid sequence of SEQ ID NOs:26, 37, and 47, respectively;

a CDR-L1, CDR-L2, and CDR-L3 comprising the amino acid sequence of SEQ ID NOs:27, 38, and 48, respectively;

a CDR-L1, CDR-L2, and CDR-L3 comprising the amino acid sequence of SEQ ID NOs:28, 39, and 49, respectively;

a CDR-L1, CDR-L2, and CDR-L3 comprising the amino acid sequence of SEQ ID NOs:30, 39, and 51, respectively;

a CDR-L1, CDR-L2, and CDR-L3 comprising the amino acid sequence of SEQ ID NOs:31, 41, and 52, respectively;

a CDR-L1, CDR-L2, and CDR-L3 comprising the amino acid sequence of SEQ ID NOs:33, 43, and 55, respectively;

a CDR-L1, CDR-L2, and CDR-L3 comprising the amino acid sequence of SEQ ID NOs:34, 44, and 56, respectively;

a CDR-L1, CDR-L2, and CDR-L3 comprising the amino acid sequence of SEQ ID NOs:174, 179, and 185, respectively;

a CDR-L1, CDR-L2, and CDR-L3 comprising the amino acid sequence of SEQ ID NOs:174, 179, and 189, respectively;

a CDR-L1, CDR-L2, and CDR-L3 comprising the amino acid sequence of SEQ ID NOs:176, 181, and 190, respectively;

a CDR-L1, CDR-L2, and CDR-L3 comprising the amino acid sequence of SEQ ID NOs:177, 182, and 191, respectively;

a CDR-L1, CDR-L2, and CDR-L3 comprising the amino acid sequence of SEQ ID NOs:174, 179, and 192, respectively;

a CDR-L1, CDR-L2, and CDR-L3 comprising the amino acid sequence of SEQ ID NOs:178, 183, and 193, respectively;

a CDR-L1, CDR-L2, and CDR-L3 comprising the amino acid sequence of SEQ ID NOs:178, 183, and 194, respectively;

a CDR-L1, CDR-L2, and CDR-L3 comprising the amino acid sequence of SEQ ID NOs:30, 399, and 415, respectively;

a CDR-L1, CDR-L2, and CDR-L3 comprising the amino acid sequence of SEQ ID NOs:380, 400, and 416, respectively;

a CDR-L1, CDR-L2, and CDR-L3 comprising the amino acid sequence of SEQ ID NOs:33, 43, and 421, respectively;

a CDR-L1, CDR-L2, and CDR-L3 comprising the amino acid sequence of SEQ ID NOs:381, 401, and 417, respectively;

a CDR-L1, CDR-L2, and CDR-L3 comprising the amino acid sequence of SEQ ID NOs:382, 402, and 418, respectively;

a CDR-L1, CDR-L2, and CDR-L3 comprising the amino acid sequence of SEQ ID NOs:601, 602, and 603, respectively;

a CDR-L1, CDR-L2, and CDR-L3 comprising the amino acid sequence of SEQ ID NOs:614, 615, and 603, respectively;

a CDR-L1, CDR-L2, and CDR-L3 comprising the amino acid sequence of SEQ ID NOs:589, 590, and 591, respectively;

a CDR-L1, CDR-L2, and CDR-L3 comprising the amino acid sequence of SEQ ID NOs:607, 608, and 591, respectively;

a CDR-L1, CDR-L2, and CDR-L3 comprising the amino acid sequence of SEQ ID NOs: 302, 304, and 306, respectively; or a CDR-L1, CDR-L2, and CDR-L3 comprising the amino acid sequence of SEQ ID NOs:303, 305, and 307, respectively.

114. The chimeric antigen receptor of any of embodiments 99-113, wherein the $V_L$ region is or comprises the amino acid sequence set forth in any of SEQ ID NOs: 116-127, 257-267, 326, 327, 534-550, 552-557, 610, 618, 775-777, or 833-849.

115. The chimeric antigen receptor of any of embodiments 99-114, wherein the $V_L$ region is or comprises the amino acid sequence set forth in any of SEQ ID NOs: 116, 117, 118, 120, 121, 124, 125, 258, 262, 263, 264, 265, 266, 267, 326, 327, 534, 535, 536, 537, 538, 610 or 618.

116. The chimeric antigen receptor of any of embodiments 99-115, wherein:

the $V_L$ region comprises a CDR-L1, CDR-L2, and CDR-L3 comprising the amino acid sequence of SEQ ID NOs: 601, 602, and 603, respectively; or the $V_L$ region comprises a CDR-L1, CDR-L2, and CDR-L3 comprising the amino acid sequence of SEQ ID NOs: 614, 615, and 603, respectively.

117. The chimeric antigen receptor of any of embodiments 99-116, wherein the $V_L$ region is or comprises the amino acid sequence set forth in SEQ ID NO:618.

118. The chimeric antigen receptor of any of embodiments 99-117, wherein:

the $V_H$ region and the $V_L$ regions comprise the amino acid sequence set forth in SEQ ID NOs:110 and 116, respectively, or a sequence of amino acids that has at least 90% identity to SEQ ID NO:110 and 116, respectively;

the $V_H$ region and the $V_L$ regions comprise the amino acid sequence set forth in SEQ ID NOs:111 and 117, respectively, or a sequence of amino acids that has at least 90% identity to SEQ ID NO:111 and 117, respectively;

the $V_H$ region and the $V_L$ regions comprise the amino acid sequence set forth in SEQ ID NOs:110 and 118, respectively, or a sequence of amino acids that has at least 90% identity to SEQ ID NO:110 and 118, respectively;

the $V_H$ region and the $V_L$ regions comprise the amino acid sequence set forth in SEQ ID NOs:110 and 119, respectively, or a sequence of amino acids that has at least 90% identity to SEQ ID NO:110 and 119, respectively;

the $V_H$ region and the $V_L$ regions comprise the amino acid sequence set forth in SEQ ID NOs:110 and 120, respectively, or a sequence of amino acids that has at least 90% identity to SEQ ID NO:110 and 120, respectively;

the $V_H$ region and the $V_L$ regions comprise the amino acid sequence set forth in SEQ ID NOs:110 and 121, respectively, or a sequence of amino acids that has at least 90% identity to SEQ ID NO:110 and 121, respectively;

the $V_H$ region and the $V_L$ regions comprise the amino acid sequence set forth in SEQ ID NOs:110 and 122, respectively, or a sequence of amino acids that has at least 90% identity to SEQ ID NO:110 and 122, respectively;

the $V_H$ region and the $V_L$ regions comprise the amino acid sequence set forth in SEQ ID NOs:110 and 123, respectively, or a sequence of amino acids that has at least 90% identity to SEQ ID NO:110 and 123, respectively;

the V$_H$ region and the V$_L$ regions comprise the amino acid sequence set forth in SEQ ID NOs:112 and 124, respectively, or a sequence of amino acids that has at least 90% identity to SEQ ID NO:112 and 124, respectively;

the V$_H$ region and the V$_L$ regions comprise the amino acid sequence set forth in SEQ ID NOs:113 and 125, respectively, or a sequence of amino acids that has at least 90% identity to SEQ ID NO:113 and 125, respectively;

the V$_H$ region and the V$_L$ regions comprise the amino acid sequence set forth in SEQ ID NOs:114 and 126, respectively, or a sequence of amino acids that has at least 90% identity to SEQ ID NO:114 and 126, respectively;

the V$_H$ region and the V$_L$ regions comprise the amino acid sequence set forth in SEQ ID NOs:115 and 127, respectively, or a sequence of amino acids that has at least 90% identity to SEQ ID NO:115 and 127, respectively;

the V$_H$ region and the V$_L$ regions comprise the amino acid sequence set forth in SEQ ID NOs:247 and 257, respectively, or a sequence of amino acids that has at least 90% identity to SEQ ID NO:247 and 257, respectively;

the V$_H$ region and the V$_L$ regions comprise the amino acid sequence set forth in SEQ ID NOs:248 and 258, respectively, or a sequence of amino acids that has at least 90% identity to SEQ ID NO:248 and 258, respectively;

the V$_H$ region and the V$_L$ regions comprise the amino acid sequence set forth in SEQ ID NOs:249 and 259, respectively, or a sequence of amino acids that has at least 90% identity to SEQ ID NO:249 and 259, respectively;

the V$_H$ region and the V$_L$ regions comprise the amino acid sequence set forth in SEQ ID NOs:250 and 260, respectively, or a sequence of amino acids that has at least 90% identity to SEQ ID NO:250 and 260, respectively;

the V$_H$ region and the V$_L$ regions comprise the amino acid sequence set forth in SEQ ID NOs:251 and 261, respectively, or a sequence of amino acids that has at least 90% identity to SEQ ID NO:251 and 261, respectively;

the V$_H$ region and the V$_L$ regions comprise the amino acid sequence set forth in SEQ ID NOs:252 and 262, respectively, or a sequence of amino acids that has at least 90% identity to SEQ ID NO:252 and 262, respectively;

the V$_H$ region and the V$_L$ regions comprise the amino acid sequence set forth in SEQ ID NOs:253 and 263, respectively, or a sequence of amino acids that has at least 90% identity to SEQ ID NO:253 and 263, respectively;

the V$_H$ region and the V$_L$ regions comprise the amino acid sequence set forth in SEQ ID NOs:254 and 264, respectively, or a sequence of amino acids that has at least 90% identity to SEQ ID NO:254 and 264, respectively;

the V$_H$ region and the V$_L$ regions comprise the amino acid sequence set forth in SEQ ID NOs:255 and 265, respectively, or a sequence of amino acids that has at least 90% identity to SEQ ID NO:255 and 265, respectively;

the V$_H$ region and the V$_L$ regions comprise the amino acid sequence set forth in SEQ ID NOs:256 and 266, respectively, or a sequence of amino acids that has at least 90% identity to SEQ ID NO:256 and 266, respectively;

the V$_H$ region and the V$_L$ regions comprise the amino acid sequence set forth in SEQ ID NOs:256 and 267, respectively, or a sequence of amino acids that has at least 90% identity to SEQ ID NO:256 and 267, respectively;

the V$_H$ region and the V$_L$ regions comprise the amino acid sequence set forth in SEQ ID NOs:518 and 534, respectively, or a sequence of amino acids that has at least 90% identity to SEQ ID NO:518 and 534, respectively;

the V$_H$ region and the V$_L$ regions comprise the amino acid sequence set forth in SEQ ID NOs:519 and 535, respectively, or a sequence of amino acids that has at least 90% identity to SEQ ID NO:519 and 535, respectively;

the V$_H$ region and the V$_L$ regions comprise the amino acid sequence set forth in SEQ ID NOs:115 and 536, respectively, or a sequence of amino acids that has at least 90% identity to SEQ ID NO:115 and 536, respectively;

the V$_H$ region and the V$_L$ regions comprise the amino acid sequence set forth in SEQ ID NOs:520 and 264, respectively, or a sequence of amino acids that has at least 90% identity to SEQ ID NO:520 and 264, respectively;

the V$_H$ region and the V$_L$ regions comprise the amino acid sequence set forth in SEQ ID NOs:521 and 537, respectively, or a sequence of amino acids that has at least 90% identity to SEQ ID NO:521 and 537, respectively;

the V$_H$ region and the V$_L$ regions comprise the amino acid sequence set forth in SEQ ID NOs:522 and 538, respectively, or a sequence of amino acids that has at least 90% identity to SEQ ID NO:522 and 538, respectively;

the V$_H$ region and the V$_L$ regions comprise the amino acid sequence set forth in SEQ ID NOs:523 and 539, respectively, or a sequence of amino acids that has at least 90% identity to SEQ ID NO:523 and 539, respectively;

the V$_H$ region and the V$_L$ regions comprise the amino acid sequence set forth in SEQ ID NOs:519 and 540, respectively, or a sequence of amino acids that has at least 90% identity to SEQ ID NO:519 and 540, respectively;

the V$_H$ region and the V$_L$ regions comprise the amino acid sequence set forth in SEQ ID NOs:524 and 541, respectively, or a sequence of amino acids that has at least 90% identity to SEQ ID NO:524 and 541, respectively;

the V$_H$ region and the V$_L$ regions comprise the amino acid sequence set forth in SEQ ID NOs:525 and 261, respectively, or a sequence of amino acids that has at least 90% identity to SEQ ID NO:525 and 261, respectively;

the V$_H$ region and the V$_L$ regions comprise the amino acid sequence set forth in SEQ ID NOs:526 and 542, respectively, or a sequence of amino acids that has at least 90% identity to SEQ ID NO:526 and 542, respectively;

the V$_H$ region and the V$_L$ regions comprise the amino acid sequence set forth in SEQ ID NOs:527 and 543, respectively, or a sequence of amino acids that has at least 90% identity to SEQ ID NO:527 and 543, respectively;

the V$_H$ region and the V$_L$ regions comprise the amino acid sequence set forth in SEQ ID NOs:528 and 544, respectively, or a sequence of amino acids that has at least 90% identity to SEQ ID NO:528 and 544, respectively;

the V$_H$ region and the V$_L$ regions comprise the amino acid sequence set forth in SEQ ID NOs:529 and 545, respectively, or a sequence of amino acids that has at least 90% identity to SEQ ID NO:529 and 545, respectively;

the V$_H$ region and the V$_L$ regions comprise the amino acid sequence set forth in SEQ ID NOs:528 and 546, respectively, or a sequence of amino acids that has at least 90% identity to SEQ ID NO:528 and 546, respectively;

the V$_H$ region and the V$_L$ regions comprise the amino acid sequence set forth in SEQ ID NOs:522 and 547, respectively, or a sequence of amino acids that has at least 90% identity to SEQ ID NO:522 and 547, respectively;

the V$_H$ region and the V$_L$ regions comprise the amino acid sequence set forth in SEQ ID NOs:256 and 548, respectively, or a sequence of amino acids that has at least 90% identity to SEQ ID NO:256 and 548, respectively;

the V$_H$ region and the V$_L$ regions comprise the amino acid sequence set forth in SEQ ID NOs:530 and 549, respectively, or a sequence of amino acids that has at least 90% identity to SEQ ID NO:530 and 549, respectively;

the V$_H$ region and the V$_L$ regions comprise the amino acid sequence set forth in SEQ ID NOs:531 and 550, respectively, or a sequence of amino acids that has at least 90% identity to SEQ ID NO:531 and 550, respectively;

the V$_H$ region and the V$_L$ regions comprise the amino acid sequence set forth in SEQ ID NOs:519 and 552, respectively, or a sequence of amino acids that has at least 90% identity to SEQ ID NO:519 and 552, respectively;

the V$_H$ region and the V$_L$ regions comprise the amino acid sequence set forth in SEQ ID NOs:110 and 553, respectively, or a sequence of amino acids that has at least 90% identity to SEQ ID NO:110 and 553, respectively;

the V$_H$ region and the V$_L$ regions comprise the amino acid sequence set forth in SEQ ID NOs:110 and 118, respectively, or a sequence of amino acids that has at least 90% identity to SEQ ID NO:110 and 118, respectively;

the V$_H$ region and the V$_L$ regions comprise the amino acid sequence set forth in SEQ ID NOs:533 and 554, respectively, or a sequence of amino acids that has at least 90% identity to SEQ ID NO:533 and 554, respectively;

the V$_H$ region and the V$_L$ regions comprise the amino acid sequence set forth in SEQ ID NOs:115 and 555, respectively, or a sequence of amino acids that has at least 90% identity to SEQ ID NO:115 and 555, respectively;

the V$_H$ region and the V$_L$ regions comprise the amino acid sequence set forth in SEQ ID NOs:524 and 556, respectively, or a sequence of amino acids that has at least 90% identity to SEQ ID NO:524 and 556, respectively;

the V$_H$ region and the V$_L$ regions comprise the amino acid sequence set forth in SEQ ID NOs:519 and 557, respectively, or a sequence of amino acids that has at least 90% identity to SEQ ID NO:519 and 557, respectively;

the V$_H$ region and the V$_L$ regions comprise the amino acid sequence set forth in SEQ ID NOs:609 and 610, respectively, or a sequence of amino acids that has at least 90% identity to SEQ ID NO:609 and 610, respectively;

the V$_H$ region and the V$_L$ regions comprise the amino acid sequence set forth in SEQ ID NOs:617 and 618, respectively, or a sequence of amino acids that has at least 90% identity to SEQ ID NO:617 and 618, respectively;

the V$_H$ region and the V$_L$ regions comprise the amino acid sequence set forth in SEQ ID NOs:324 and 326, respectively, or a sequence of amino acids that has at least 90% identity to SEQ ID NO:324 and 326, respectively; or the V$_H$ region and the V$_L$ regions comprise the amino acid sequence set forth in SEQ ID NOs:325 and 327, respectively, or a sequence of amino acids that has at least 90% identity to SEQ ID NO:325 and 327, respectively.

119. A chimeric antigen receptor of any of embodiments 99-118, wherein:

the V$_H$ region and the V$_L$ regions comprise the amino acid sequence set forth in SEQ ID NOs:110 and 116, respectively, or a sequence of amino acids that has at least 90% identity to SEQ ID NO:110 and 116, respectively;

the V$_H$ region and the V$_L$ regions comprise the amino acid sequence set forth in SEQ ID NOs:111 and 117, respectively, or a sequence of amino acids that has at least 90% identity to SEQ ID NO:111 and 117, respectively;

the V$_H$ region and the V$_L$ regions comprise the amino acid sequence set forth in SEQ ID NOs:110 and 118, respectively, or a sequence of amino acids that has at least 90% identity to SEQ ID NO:110 and 118, respectively;

the V$_H$ region and the V$_L$ regions comprise the amino acid sequence set forth in SEQ ID NOs:110 and 120, respectively, or a sequence of amino acids that has at least 90% identity to SEQ ID NO:110 and 120, respectively;

the V$_H$ region and the V$_L$ regions comprise the amino acid sequence set forth in SEQ ID NOs:110 and 121, respectively, or a sequence of amino acids that has at least 90% identity to SEQ ID NO:110 and 121, respectively;

the V$_H$ region and the V$_L$ regions comprise the amino acid sequence set forth in SEQ ID NOs:112 and 124, respectively, or a sequence of amino acids that has at least 90% identity to SEQ ID NO:112 and 124, respectively;

the V$_H$ region and the V$_L$ regions comprise the amino acid sequence set forth in SEQ ID NOs:113 and 125, respectively, or a sequence of amino acids that has at least 90% identity to SEQ ID NO:113 and 125, respectively;

the V$_H$ region and the V$_L$ regions comprise the amino acid sequence set forth in SEQ ID NOs:248 and 258, respectively, or a sequence of amino acids that has at least 90% identity to SEQ ID NO:248 and 258, respectively;

the V$_H$ region and the V$_L$ regions comprise the amino acid sequence set forth in SEQ ID NOs:252 and 262, respectively, or a sequence of amino acids that has at least 90% identity to SEQ ID NO:252 and 262, respectively;

the V$_H$ region and the V$_L$ regions comprise the amino acid sequence set forth in SEQ ID NOs:253 and 263, respectively, or a sequence of amino acids that has at least 90% identity to SEQ ID NO:253 and 263, respectively;

the V$_H$ region and the V$_L$ regions comprise the amino acid sequence set forth in SEQ ID NOs:254 and 264, respectively, or a sequence of amino acids that has at least 90% identity to SEQ ID NO:254 and 264, respectively;

the V$_H$ region and the V$_L$ regions comprise the amino acid sequence set forth in SEQ ID NOs:255 and 265, respectively, or a sequence of amino acids that has at least 90% identity to SEQ ID NO:255 and 265, respectively;

the V$_H$ region and the V$_L$ regions comprise the amino acid sequence set forth in SEQ ID NOs:256 and 266, respectively, or a sequence of amino acids that has at least 90% identity to SEQ ID NO:256 and 266, respectively;

the V$_H$ region and the V$_L$ regions comprise the amino acid sequence set forth in SEQ ID NOs:256 and 267, respectively, or a sequence of amino acids that has at least 90% identity to SEQ ID NO:256 and 267, respectively;

the V$_H$ region and the V$_L$ regions comprise the amino acid sequence set forth in SEQ ID NOs:518 and 534, respectively, or a sequence of amino acids that has at least 90% identity to SEQ ID NO:518 and 534, respectively;

the V$_H$ region and the V$_L$ regions comprise the amino acid sequence set forth in SEQ ID NOs:519 and 535, respectively, or a sequence of amino acids that has at least 90% identity to SEQ ID NO:519 and 535, respectively;

the V$_H$ region and the V$_L$ regions comprise the amino acid sequence set forth in SEQ ID NOs:115 and 536, respectively, or a sequence of amino acids that has at least 90% identity to SEQ ID NO:115 and 536, respectively;

the V$_H$ region and the V$_L$ regions comprise the amino acid sequence set forth in SEQ ID NOs:520 and 264, respectively, or a sequence of amino acids that has at least 90% identity to SEQ ID NO:520 and 264, respectively;

the V$_H$ region and the V$_L$ regions comprise the amino acid sequence set forth in SEQ ID NOs:521 and 537, respectively, or a sequence of amino acids that has at least 90% identity to SEQ ID NO:521 and 537, respectively;

the V$_H$ region and the V$_L$ regions comprise the amino acid sequence set forth in SEQ ID NOs:522 and 538, respectively, or a sequence of amino acids that has at least 90% identity to SEQ ID NO:522 and 538, respectively;

the V_H region and the V_L regions comprise the amino acid sequence set forth in SEQ ID NOs:609 and 610, respectively, or a sequence of amino acids that has at least 90% identity to SEQ ID NO:609 and 610, respectively;

the V_H region and the V_L regions comprise the amino acid sequence set forth in SEQ ID NOs:617 and 618, respectively, or a sequence of amino acids that has at least 90% identity to SEQ ID NO:617 and 618, respectively;

the V_H region and the V_L regions comprise the amino acid sequence set forth in SEQ ID NOs:324 and 326, respectively, or a sequence of amino acids that has at least 90% identity to SEQ ID NO:324 and 326, respectively; or the V_H region and the V_L regions comprise the amino acid sequence set forth in SEQ ID NOs:325 and 327, respectively, or a sequence of amino acids that has at least 90% identity to SEQ ID NO:325 and 327, respectively.

120. The chimeric antigen receptor of any of embodiments 99-119, wherein the fragment comprises an scFv.

121. The chimeric antigen receptor of any of embodiments 99-120, when the V_H region and the V_L region are joined by a flexible linker.

122. The chimeric antigen receptor of embodiment 121, wherein the scFv comprises a linker comprising the amino acid sequence GGGGSGGGGSGGGGS (SEQ ID NO:361).

123. The chimeric antigen receptor of any of embodiments 99-122, wherein the V_H region is amino-terminal to the V_L region.

124. The chimeric antigen receptor of any of embodiments 99-123, wherein the antigen-binding domain comprises the amino acid sequence selected from any one of SEQ ID NOs:128-139, 268-278, 329, 442, 478, 558-576, 578-583, 585, or 769-771 or an amino acid sequence having at least 90%, 91%, 92%, 93%, 94%, 95%, 96%, 97%, 98%, or 99% sequence identity to the amino acid sequence selected from any one of SEQ ID NOs: 128-139, 268-278, 329, 442, 478, 558-576, 578-583, 585, or 769-771.

125. The chimeric antigen receptor of any of embodiments 99-124, wherein the antigen-binding domain comprises the amino acid sequence selected from any one of SEQ ID NOs:128-130, 132, 133, 136, 137, 269, 273-278, 329, 442, 478, 558-563 or 585 or an amino acid sequence having at least 90%, 91%, 92%, 93%, 94%, 95%, 96%, 97%, 98%, or 99% sequence identity to the amino acid sequence selected from any one of SEQ ID NOs: 128-130, 132, 133, 136, 137, 269, 273-278, 329, 442, 478, 558-563 or 585.

126. The chimeric antigen receptor of any of embodiments 99-122, wherein the V_H region is carboxy-terminal to the V_L region.

127. The chimeric antigen receptor of any of embodiments 99-122 and 126, wherein the scFv comprises the amino acid sequence set forth in SEQ ID NOs:328 or 586, or an amino acid sequence having at least 90%, 91%, 92%, 93%, 94%, 95%, 96%, 97%, 98%, or 99% sequence identity to the amino acid sequence set forth in SEQ ID NO:328 or 586.

128. The chimeric antigen receptor of any of embodiments 89-127, wherein the intracellular signaling region comprises an activating cytoplasmic signaling domain.

129. The chimeric antigen receptor of embodiment 128, wherein the activating cytoplasmic signaling domain is capable of inducing a primary activation signal in a T cell, is a T cell receptor (TCR) component and/or comprises an immunoreceptor tyrosine-based activation motif (ITAM).

130. The chimeric antigen receptor of embodiment 128 or embodiment 129, wherein the activating cytoplasmic signaling domain is or comprises a cytoplasmic signaling domain of a zeta chain of a CD3-zeta (CD3ζ) chain or a functional variant or signaling portion thereof.

131. The chimeric antigen receptor of any of embodiments 128-130, wherein the activating cytoplasmic domain is human or is derived from a human protein.

132. The chimeric antigen receptor of any of embodiments 128-131, wherein the activating cytoplasmic domain is or comprises the sequence set forth in SEQ ID NO:628 or a sequence of amino acids that has at least 90% sequence identity to SEQ ID NO:628.

133. The chimeric antigen receptor of any of embodiments 128-132, wherein the intracellular signaling region further comprises a costimulatory signaling region.

134. The chimeric antigen receptor of embodiment 133, wherein the costimulatory signaling region comprises an intracellular signaling domain of a T cell costimulatory molecule or a signaling portion thereof.

135. The chimeric antigen receptor of embodiment 133 or embodiment 134, wherein the costimulatory signaling region comprises an intracellular signaling domain of a CD28, a 4-1BB or an ICOS or a signaling portion thereof.

136. The chimeric antigen receptor of any of embodiments 133-135, wherein the costimulatory signaling region comprises an intracellular signaling domain of 4-1BB.

137. The chimeric antigen receptor of any of embodiments 133-136, wherein the costimulatory signaling region is human or is derived from a human protein.

138. The chimeric antigen receptor of any of embodiments 133-137, wherein the costimulatory signaling region is or comprises the sequence set forth in SEQ ID NO:626 or a sequence of amino acids that exhibits at least 90% sequence identity to the sequence set forth in SEQ ID NO: 626.

139. The chimeric antigen receptor of any of embodiments 133-139, wherein the costimulatory signaling region is between the transmembrane domain and the intracellular signaling region.

140. The chimeric antigen receptor of any of embodiments 89-139, wherein the transmembrane domain is or comprises a transmembrane domain derived from CD4, CD28, or CD8.

141. The chimeric antigen receptor of embodiment 140, wherein the transmembrane domain is or comprises a transmembrane domain derived from a CD28.

142. The chimeric antigen receptor of any of embodiments 89-141, wherein the transmembrane domain is human or is derived from a human protein.

143. The chimeric antigen receptor of any of embodiments 89-142, wherein the transmembrane domain is or comprises the sequence set forth in SEQ ID NO:624 or a sequence of amino acids that exhibits at least 90% sequence identity to SEQ ID NO:624.

144. The chimeric antigen receptor of any of embodiments 89-143, wherein the encoded chimeric antigen receptor comprises from its N to C terminus in order: the antigen-binding domain, the spacer, the transmembrane domain and the intracellular signaling domain.

145. An engineered cell, comprising the polynucleotide of any of embodiments 1-87 and 173-180.

146. An engineered cell, comprising the chimeric antigen receptor of any of embodiments 88-144 and 181.

147. The engineered cell of embodiment 145 or embodiment 146, wherein the cell is an immune cell.

148. The engineered cell of embodiment 147, wherein the immune cell is a primary cell obtained from a subject.

149. The engineered cell of embodiment 147 or embodiment 148, wherein the immune cell is an NK cell or a T cell.

150. The engineered cell of any of embodiments 147-149, wherein the immune cell is a T cell and the T cell is a CD4+ and/or CD8+ T cell.

151. The engineered cell of any of embodiments 145-150, wherein the cell comprises transcribed RNA encoding the chimeric antigen receptor, optionally messenger RNA (mRNA), that exhibits at least 70%, 75%, 80%, 85%, 90%, or 95% RNA homogeneity.

152. The engineered cell of any of embodiments 145-151, wherein the cell comprises transcribed RNA encoding the chimeric antigen receptor, optionally messenger RNA (mRNA), that exhibits reduced heterogeneity compared to the heterogeneity of transcribed mRNA in a cell encoding a reference chimeric antigen receptor, said reference chimeric antigen receptor comprising the same amino acid sequence as the chimeric antigen receptor but encoded by a different polynucleotide sequence comprising one or more nucleotide differences in the polynucleotide encoding the CARs and/or in which the reference chimeric antigen receptor is encoded by a polynucleotide comprising one or more splice donor site and/or one or more splice acceptor site in the nucleic acid encoding the spacer.

153. The engineered cell of embodiment 152, wherein the RNA heterogeneity is reduced by greater than or greater than about 10%, 15%, 20%, 25%, 30%, 40%, 50% or more.

154. The engineered cell of embodiment 152 or embodiment 153, wherein the cell encoding the reference CAR comprises transcribed RNA encoding the reference CAR, optionally messenger RNA (mRNA), that exhibits greater than or greater than about 10%, 15%, 20%, 25%, 30%, 40%, 50% or more RNA heterogeneity.

155. The engineered cell of any of embodiments 151-154, wherein the RNA homogeneity and/or heterogeneity is determined by agarose gel electrophoresis, chip-based capillary electrophoresis, analytical ultracentrifugation, field flow fractionation, or liquid chromatography.

156. The engineered cell of any of embodiments 145-155, wherein, among a plurality of the engineered cells, less than or less than about 10%, 9%, 8%, 7%, 5%, 4%, 3%, 2% or 1% of the cells in the plurality comprise a chimeric antigen receptor that exhibits tonic signaling and/or antigen independent activity or signaling.

157. A composition comprising the polynucleotide of any of embodiments 1-87 and 173-179, the chimeric antigen receptor of any one of embodiments 88-144 and 180, or the engineered cell of any one of embodiments 144-156.

158. The composition of embodiment 157, further comprising a pharmaceutically acceptable excipient.

159. The composition of embodiment 157 or embodiment 158 that is sterile.

160. A method of treatment, comprising administering the engineered cells of any of embodiments 144-156 or the composition of any of embodiments 157-159 to a subject having a disease or disorder.

161. The method of embodiment 160, wherein the disease or disorder is associated with expression of B cell maturation antigen (BCMA).

162. The method of any embodiment 160 or embodiment 161, wherein the disease or disorder associated with BCMA is a B cell-related disorder.

163. The method of any one of embodiments 160-162, wherein the disease or disorder associated with BCMA is an autoimmune disease or disorder.

164. The method of embodiment 163, wherein the autoimmune disease or disorder is systemic lupus erythematosus (SLE), lupus nephritis, inflammatory bowel disease, rheumatoid arthritis, ANCA associated vasculitis, idiopathic thrombocytopenia purpura (ITP), thrombotic thrombocytopenia purpura (TTP), autoimmune thrombocytopenia, Chagas' disease, Grave's disease, Wegener's granulomatosis, poly-arteritis nodosa, Sjogren's syndrome, pemphigus vulgaris, scleroderma, multiple sclerosis, psoriasis, IgA nephropathy, IgM polyneuropathies, vasculitis, diabetes mellitus, Reynaud's syndrome, anti-phospholipid syndrome, Goodpasture's disease, Kawasaki disease, autoimmune hemolytic anemia, myasthenia gravis, or progressive glomerulonephritis.

165. The method of any one of embodiments 160-164, wherein the disease or disorder associated with BCMA is a cancer.

166. The method of embodiment 165, wherein the cancer is a BCMA-expressing cancer.

167. The method of embodiment 165 or 166, wherein the cancer is a B cell malignancy.

168. The method of any one of embodiments 165-167, wherein the cancer is a lymphoma, a leukemia, or a plasma cell malignancy.

169. The method of embodiment 168, wherein the cancer is a lymphoma and the lymphoma is Burkitt's lymphoma, non-Hodgkin's lymphoma (NHL), Hodgkin's lymphoma, Waldenstrom macroglobulinemia, follicular lymphoma, small non-cleaved cell lymphoma, mucosa-associated lymphatic tissue lymphoma (MALT), marginal zone lymphoma, splenic lymphoma, nodal monocytoid B cell lymphoma, immunoblastic lymphoma, large cell lymphoma, diffuse mixed cell lymphoma, pulmonary B cell angiocentric lymphoma, small lymphocytic lymphoma, primary mediastinal B cell lymphoma, lymphoplasmacytic lymphoma (LPL), or mantle cell lymphoma (MCL).

170. The method of embodiment 168, wherein the cancer is a leukemia and the leukemia is chronic lymphocytic leukemia (CLL), plasma cell leukemia or acute lymphocytic leukemia (ALL).

171. The method of embodiment 168, wherein the cancer is a plasma cell malignancy and the plasma cell malignancy is multiple myeloma (MM) or plasmacytoma.

172. The method of any of embodiments 165-168 and 171, wherein the cancer is multiple myeloma (MM).

173. The polynucleotide of any of embodiments 1-87, wherein the antigen-binding domain and/or the encoded chimeric antigen receptor exhibits preferential binding to, and/or exhibits greater binding affinity for, membrane bound BCMA compared to soluble BCMA.

174. The polynucleotide of any of embodiments 1-87 and 173, wherein the polynucleotide comprises the sequence set forth in any of SEQ ID NOS: 751-762 or a sequence that exhibits at least 85%, 86%, 87%, 88%, 89%, 90%, 91%, 92%, 93%, 94%, 95%, 96%, 97%, 98%, or 99% sequence identity to the sequence set forth in any of SEQ ID NOS: 751-762 and retains the function to bind to BCMA and retains the reduced RNA heterogeneity.

175. The polynucleotide of any of embodiments 1-87, 173 and 174, wherein one of more of the hinge, $C_H2$ and $C_H3$ is derived all or in part from IgG4 or IgG2, optionally human IgG4 or human IgG2.

176. The polynucleotide of embodiment any of embodiments 1-87, 173-175, wherein the hinge, $C_H2$ and $C_H3$ is derived from IgG4.

177. The polynucleotide of any of embodiments 1-87 and 173-176, wherein one or more of the hinge, $C_H2$ and $C_H3$ is chimeric and comprises sequence derived from IgG4 and IgG2.

178. The polynucleotide of embodiment 177, wherein the spacer comprises an IgG4/2 chimeric hinge or a modified IgG4 comprising at least one amino acid replacement compared to human IgG4, an IgG2/4 chimeric $C_H2$, and an IgG4 $C_H3$ region.

179. The polynucleotide of any of embodiments 1-87 and 173-178, wherein the encoded spacer is or comprises the sequence set forth in SEQ ID NO: 649.

180. The chimeric antigen receptor of any of embodiments 88-144, wherein the antigen-binding domain and or the chimeric antigen receptor exhibits preferential binding to, and/or exhibits greater binding affinity for, membrane bound BCMA compared to soluble BCMA.

181. The chimeric antigen receptor of any of 181. The chimeric antigen receptor of any of embodiments 88-144, wherein the antigen-binding domain and or the chimeric antigen receptor, or a measure indicative of function or activity of the encoded chimeric antigen receptor following exposure to cells expressing surface BCMA, is not reduced or blocked or is not substantially reduced or blocked in the presence of a soluble or shed form of BCMA.

182. The chimeric antigen receptor of embodiment 181, wherein the concentration or amount of the soluble or shed form of the BCMA corresponds to a concentration or amount present in serum or blood or plasma of the subject or of a multiple myeloma patient, or on average in a patient population for the disease or disorder, or at a concentration or amount of the soluble or shed BCMA at which the binding or measure is reduced or blocked, or is substantially reduced or blocked, for cells expressing a reference anti-BCMA recombinant receptor, optionally a reference anti-BCMA CAR, in the same assay.

183. A method of determining the heterogeneity of a transcribed nucleic acid of a transgene, the method comprising:
   a) amplifying a transcribed nucleic acid using at least one 5' and 3' primer pair, wherein at least one pair comprises a 5' primer that is complementary to a nucleic acid sequence within the 5' untranslated region (5' UTR) of the transcribed nucleic acid and a 3' primer that is complementary to a nucleic acid sequence within the 3' untranslated region (3' UTR) of the transcribed nucleic acid to generate one or more amplified products; and
   b) detecting the amplified products, wherein the presence of two or more amplified products from at least one 5' and 3' primer pair indicates heterogeneity in the amplified products.

184. The method of embodiment 183 wherein the detected differences in b) are different lengths of the amplified transcripts.

185. The method of embodiment 183 wherein the differences in b) are differences in chromatographic profiles of the amplified transcripts.

186. The method of any of embodiments 183-185, wherein the differences in the amplified products are determined by agarose gel electrophoresis, chip-based capillary electrophoresis, analytical ultracentrifugation, field flow fractionation, or chromatography.

187. The method of any of embodiments 183-186, wherein the 5' primer is specific to sequence transcribed from the promoter region of the transcribed nucleic acid.

188. The method of any of embodiments 183-187, wherein the transcribed nucleic acid is amplified using a 3' primer specific to a sequence within the amino acid-coding sequence of the polynucleotide, and/or the 3' untranslated region of the transcribed pre-mRNA.

189. The method of any of embodiments 183-188, wherein the 3 primer is specific to the polyadenylation sequence or enhancer region of the 3' untranslated region of the transcribed pre-mRNA.

190. The method of any of embodiments 183-189, wherein step a) is effected by a single amplification reaction, using a single 5' and 3' primer pair comprising a 5' primer that is complementary to a nucleic acid sequence within the 5' untranslated region (5' UTR) of the transcribed nucleic acid and a 3' primer that is complementary to a nucleic acid sequence within the 3' untranslated region (3' UTR).

191. The method of any of embodiments 183-190, wherein step a) is effected by parallel or subsequent amplification reactions using a first 5' and 3' primer pair, a second 5' and 3'primer pair, and optionally additional 5' and 3'primer pairs, wherein:
   the first 5' and 3'primer pair contains a 5' primer that is complementary to a nucleic acid sequence within the 5' UTR of the transcribed nucleic acid and a 3' primer that is complementary to a nucleic acid sequence within the 3' UTR of the transcribed nucleic acid;
   the second 5' and 3' primer pair contains a 5' primer whose sequence is complementary to a portion of the translated sequence of the nucleic acid transcript and a 3' primer whose sequence is complementary to a nucleic acid sequence within the 3' UTR of the transcript; and
   the optionally additional 5' and 3'primer pairs each contain sequences complementary to sequences within the translated region of the transcript.

192. The method of embodiment 191, wherein the parallel or subsequent amplification reactions amplify overlapping portions of the transcript.

193. The method of any of embodiments 183-192, wherein the amplified products are predicted to be about 1.5 kilobases, 2 kilobases, 2.5 kilobases, 3 kilobases, 3.5 kilobases, 4 kilobases, 4.5 kilobases, 5 kilobases, 5.5 kilobases, 6 kilobases, 7 kilobases, or 8 kilobases in length.

194. The method of any of embodiments 183-193, wherein a transcribed nucleic acid that is detected as having heterogeneity is identified as a transgene candidate for removal of one or more splice site.

195. The method of embodiment 194, wherein the transcribed nucleic acid of the transgene candidate exhibits at least or at least about 5%, 10%, 15%, 20%, 25%, 30%, 40%, 45%, 50%, 55%, 60%, 65%, 70%, 75% or more heterogeneity following expression in a cell.

196. A method of reducing the heterogeneity of an expressed transgene transcript, the method comprising:
   a) identifying a transgene candidate for the removal of splice sites according to the method of embodiment 194 or embodiment 195;
   b) identifying one or more potential splice donor and/or splice acceptor sites; and
   c) modifying the nucleic acid sequence at or near the one or more identified splice donor sites identified in b), thereby generating a modified polynucleotide.

197. The method of embodiment 196, further comprising:
   d) assessing the transgene candidacy for the removal of splice sites as in step a).

198. The method of embodiment 197, further comprising e) repeating steps b)-d) until the heterogeneity of the transcript in step d) is reduced compared to the heterogeneity of the transcript as determined in step a).

199. The method of any of embodiments 196-198, wherein the one or more potential splice donor and/or splice acceptor sites exhibit a score about or at least about 0.7, 0.75, 0.8, 0.85, 0.9, 0.95, or 1.0 of a splice event or probability of a splice event.

200. The method of any of embodiments 196-199, wherein splice donor sites and splice acceptor sites are identified independently.

201. The method of any of embodiments 196-200, wherein the splice acceptor and/or donor site(s) is/are canonical, non-canonical, and/or cryptic splice acceptor and/or donor site(s).

202. The method of any of embodiments 196-201, wherein the transgene is a chimeric antigen receptor or a portion of a chimeric antigen receptor.

203. The method of embodiment 202, wherein the CAR polypeptide comprises an antigen-binding domain comprising an antibody fragment, optionally a single chain antibody fragment (scFv), comprising a variable heavy chain ($V_H$) and a variable light chain ($V_L$), a spacer region, a transmembrane region, and an intracellular signaling region.

204. The method of embodiment 202 or embodiment 203, wherein the modified polynucleotide is not modified within the coding sequence for the antigen-binding domain of the encoded CAR polypeptide.

205. The method of any of embodiments 196-204, wherein the encoded amino acid sequence of the transgene is unchanged following modification of the polynucleotide.

206. The method of any of embodiments 196-205, wherein the RNA transcribed from the modified polynucleotide exhibits at least or at least about 70%, 75%, 80%, 85%, 90%, or 95% homogeneity following expression of the unmodified polynucleotide in a cell.

207. The method of any of embodiments 183-206, wherein the cell is a human cell. 208. The method of any of embodiments 183-207, wherein the cell is a T-cell.

IX. EXAMPLES

The following examples are included for illustrative purposes only and are not intended to limit the scope of the invention.

Example 1: Generation and Assessment of Anti-BCMA Antibodies ($V_H$ Chain Only)

Exemplary anti-BCMA antibodies containing a heavy chain variable ($V_H$) region that specifically bound to BCMA, even in the absence of a light chain variable ($V_L$) region, were generated and assessed.

A. Library Selection and Antibody Generation

A number of BCMA-binding $V_H$ regions were generated through a series of selection steps carried out on members of a dsDNA-encoded His-tagged human normal donor antibody $V_H$ library displayed in a cell-free system. Members of the $V_H$ library were subjected to multiple rounds of screening to select $V_H$ regions that bound specifically to soluble human BCMA fused to an immunoglobulin Fc region (hBMCA-Fc). $V_H$ regions from selected hBCMA-Fc pools were screened, by flow cytometry using a fluorochrome-conjugated anti-HIS antibody, for binding to a recombinant HEK293 cell line expressing human BCMA (hBCMA/HEK293 cell line), as compared to the parental HEK293 cell line not expressing BCMA, as well as to for binding to a human myeloma cell line expressing endogenous BCMA (H929 cells). The results identified $V_H$ region clones that exhibited specific binding to hBCMA/HEK293 cells and, to a lesser degree, to H929 cells.

Exemplary $V_H$ clones exhibiting specific binding to cell lines expressing BCMA but not to BCMA-negative control cells were sequenced and purified for further characterization. Clones were purified and titrated, and their binding affinities ($EC_{50}$) to hBCMA/HEK293 cells were measured using a flow cytometry-based assay with the fluorochrome-conjugated anti-HIS-antibody. Table E1 lists heavy chain complementarity determining region 3 (CDR-H3) sequences of exemplary clones, containing human $V_H3$-derived framework regions and their respective binding affinities ($EC_{50}$) observed in this study.

TABLE E1

| | CDR3 amino acid sequences for representative $V_H$ clones | | |
|---|---|---|---|
| $V_H$ Clone Name | Heavy Chain CDR3 sequence (CDR-H3)[a] | CDR-H3 Sequence Identifier Number | $EC_{50}$ (nM)[b] |
| $V_H$-1 | VDGPPSFDI | SEQ ID NO: 10 | >100 |
| $V_H$-2 | WSAPTDY | SEQ ID NO: 7 | 25 |
| $V_H$-3 | VDGDDAFDI | SEQ ID NO: 279 | >100 |
| $V_H$-4 | DPLSWDSSGKGPR | SEQ ID NO: 280 | 100 |
| $V_H$-5 | ENYDFWSWRYYYDMDV | SEQ ID NO: 281 | >100 |
| $V_H$-6 | VDGPPSYDI | SEQ ID NO: 282 | >100 |
| $V_H$-7 | GDWDDAFDI | SEQ ID NO: 283 | >100 |
| $V_H$-8 | VDGDYVDDY | SEQ ID NO: 9 | ND |
| $V_H$-9 | VDGDYEDY | SEQ ID NO: 284 | >100 |
| $V_H$-10 | DVPSSGDDAFDI | SEQ ID NO: 285 | >100 |
| $V_H$-11 | VDGDDVFDI | SEQ ID NO: 286 | >100 |
| $V_H$-12 | VDGDAFDI | SEQ ID NO: 287 | 100 |

[a]According to Kabat numbering.
[b]ND indicates not detected

Example 2: Generation and Assessment of Anti-BCMA Antibodies (scFvs)

Exemplary anti-BCMA antibodies, formatted as single chain antibody fragments (scFvs), were identified and assessed for binding to BCMA.

A. Library Selection and scFv Antibody Generation

Exemplary anti-BCMA scFv antibodies were generated through various selections, carried out on dsDNA-encoded human normal donor antibody libraries displayed in a cell-free system. In one approach, $V_H$ region library members enriched from a first round of screening in the approach described in Example 1 were paired by shuffling with members of a human normal donor $V_L$ library, to generate an scFv library, in $V_H$-$(G_4S)_3$-$V_L$ format. The resulting scFv libraries were enriched in subsequent rounds of selection for specific binding to BCMA-expressing HEK293 cells as compared to parental HEK293 cells.

In another approach, de novo selection was carried out by screening a normal donor-derived human scFv library for BCMA-specific binding to hBCMA-Fc in the presence or absence of competitive elution with a mouse anti-BCMA reference scFv antibody (either BCMA-C1, $V_L$-$V_H$ scFv antibody, SEQ ID NO:328; or BCMA-C2, $V_H$-$V_L$ scFv antibody, SEQ ID NO:329). After at least 2 rounds of selection, scFv binders were recovered.

Specific binding of resulting scFv clones to BCMA-expressing HEK293 cells, as compared to control cells not expressing BCMA, was assessed by flow cytometry either with in vitro translated crude cell lysate or with bacterially-produced supernatant. Certain scFv clones displaying binding preference for BCMA were further analyzed.

The selected scFv clones were sequenced using forward and reverse primers and purified for further characterization. Table E2 lists sequence identifiers (SEQ ID NO) corresponding to amino acid (aa) and nucleotide (nt) sequences of the scFv and amino acid sequences of the corresponding heavy chain ($V_H$) or light chain ($V_L$) variable regions, CDRs and framework regions (FRs). With respect to clone BCMA-22, the first residue of light chain CDR3 (a cysteine), which was observed to have been inherited from the germline framework region was replaced with a serine to generate an additional scFv, designated BCMA-23. Table E2 also sets forth the sequence of exemplary mouse anti-BCMA reference antibodies used as controls and in competition studies as described in subsequent Examples.

TABLE E2

| | Sequence identifier (SEQ ID NO) for Exemplary Clones | | | | | | |
|---|---|---|---|---|---|---|---|
| | Heavy Chain | | | Light Chain | | | scFv |
| Clone # | $V_H$ | CDR-H1, CDR-H2, CDR-H3 | $V_H$ FR (FR1, 2, 3, 4 Kabat) | $V_L$ | CDR-L1, CDR-L2, CDR-L3 | $V_L$ FR (FR1, 2, 3, 4, Kabat) | aa  nt |
| BCMA-1 | 110 | 1, 4, 7 (Kabat) 12, 16, 7 (Chothia) 19, 23, 7 (AbM) | 59, 64, 67, 70 | 116 | 26, 37, 47 (Kabat) 26, 37, 47 (Chothia) 26, 37, 47 (AbM) | 72, 83, 93, 102 | 128  330 |
| BCMA-2 | 111 | 2, 5, 8 (Kabat) 13, 17, 8 (Chothia) 20, 24, 8 (AbM) | 60, 65, 68, 71 | 117 | 27, 38, 48 (Kabat) 27, 38, 48 (Chothia) 27, 38, 48 (AbM) | 73, 84, 94, 103 | 129  331 |
| BCMA-3 | 110 | 1, 4, 7 (Kabat) 12, 16, 7 (Chothia) 19, 23, 7 (AbM) | 59, 64, 67, 70 | 118 | 28, 39, 49 (Kabat) 28, 39, 49 (Chothia) 28, 39, 49 (AbM) | 74, 85, 93, 104 | 130  332 |
| BCMA-4 | 110 | 1, 4, 7 (Kabat) 12, 16, 7 (Chothia) 19, 23, 7 (AbM) | 59, 64, 67, 70 | 119 | 29, 40, 50 (Kabat) 29, 40, 50 (Chothia) 29, 40, 50 (AbM) | 75, 86, 95, 104 | 131  333 |
| BCMA-5 | 110 | 1, 4, 7 (Kabat) 12, 16, 7 (Chothia) 19, 23, 7 (AbM) | 59, 64, 67, 70 | 120 | 30, 39, 51 (Kabat) 30, 39, 51 (Chothia) 30, 39, 51 (AbM) | 76, 85, 93, 105 | 132  334 |
| BCMA-6 | 110 | 1, 4, 7 (Kabat) 12, 16, 7 (Chothia) 19, 23, 7 (AbM) | 59, 64, 67, 70 | 121 | 31, 41, 52 (Kabat) 31, 41, 52 (Chothia) 31, 41, 52 (AbM) | 77, 87, 96, 104 | 133  335 |
| BCMA-7 | 110 | 1, 4, 7 (Kabat) 12, 16, 7 (Chothia) 19, 23, 7 (AbM) | 59, 64, 67, 70 | 122 | 32, 42, 53 (Kabat) 32, 42, 53 (Chothia) 32, 42, 53 (AbM) | 78, 88, 97, 106 | 134  336 |
| BCMA-8 | 110 | 1, 4, 7 (Kabat) 12, 16, 7 (Chothia) 19, 23, 7 (AbM) | 59, 64, 67, 70 | 123 | 30, 39, 54 (Kabat) 30, 39, 54 (Chothia) 30, 39, 54 (AbM) | 76, 85, 93, 107 | 135  337 |
| BCMA-9 | 112 | 2, 5, 9 (Kabat) 13, 17, 9 (Chothia) 20, 24, 9 (AbM) | 61, 65, 69, 70 | 124 | 33, 43, 55 (Kabat) 33, 43, 55 (Chothia) 33, 43, 55 (AbM) | 79, 89, 98, 108 | 136  338 |
| BCMA-10 | 113 | 2, 5, 10 (Kabat) 14, 17, 10 (Chothia) 21, 24, 10 (AbM) | 62, 65, 68, 71 | 125 | 34, 44, 56 (Kabat) 34, 44, 56 (Chothia) 34, 44, 56 (AbM) | 80, 90, 99, 108 | 137  339 |
| BCMA-11 | 114 | 3, 6, 11 (Kabat) 15, 18, 11 (Chothia) 22, 25, 11 (AbM) | 63, 66, 69, 71 | 126 | 35, 45, 57 (Kabat) 35, 45, 57 (Chothia) 35, 45, 57 (AbM) | 81, 91, 100, 108 | 138  340 |
| BCMA-12 | 115 | 2, 5, 10 (Kabat) 13, 17, 10 (Chothia) 20, 24, 10 (AbM) | 60, 65, 68, 71 | 127 | 36, 46, 58 (Kabat) 36, 46, 58 (Chothia) 36, 46, 58 (AbM) | 82, 92, 101, 109 | 139  341 |
| BCMA-13 | 247 | 140, 145, 149 (Kabat) 158, 161, 149 (Chothia) 165, 170, 149 (AbM) | 195, 204, 210, 217 | 257 | 174, 179, 184 (Kabat) 174, 179, 184 (Chothia) 174, 179, 184 (AbM) | 221, 228, 233, 243 | 268  342 |
| BCMA-14 | 248 | 141, 145, 149 (Kabat) 158, 161, 149 (Chothia) 166, 170, 149 (AbM) | 196, 204, 211, 218 | 258 | 174, 179, 185 (Kabat) 174, 179, 185 (Chothia) 174, 179, 185 (AbM) | 221, 228, 234, 109 | 269  343 |
| BCMA-15 | 249 | 141, 145, 150 (Kabat) 158, 161, 150 (Chothia) 166, 170, 150 (AbM) | 197, 204, 212, 70 | 259 | 174, 179, 186 (Kabat) 174, 179, 186 (Chothia) 174, 179, 186 (AbM) | 222, 228, 235, 109 | 270  344 |
| BCMA-16 | 250 | 142, 146, 151 (Kabat) 159, 162, 151 (Chothia) 167, 171, 151 (AbM) | 198, 205, 213, 70 | 260 | 174, 179, 187 (Kabat) 174, 179, 187 (Chothia) 174, 179, 187 (AbM) | 223, 228, 235, 109 | 271  345 |
| BCMA-17 | 251 | 2, 5, 152 (Kabat) 13, 17, 152 (Chothia) 20, 24, 152 (AbM) | 199, 206, 69, 219 | 261 | 175, 180, 188 (Kabat) 175, 180, 188 (Chothia) 175, 180, 188 (AbM) | 224, 229, 237, 109 | 272  346 |
| BCMA-18 | 252 | 143, 147, 153 (Kabat) 158, 163, 153 (Chothia) 168, 172, 153 (AbM) | 200, 207, 214, 70 | 262 | 174, 179, 189 (Kabat) 174, 179, 189 (Chothia) 174, 179, 189 (AbM) | 222, 228, 238, 109 | 273  347 |
| BCMA-19 | 253 | 144, 148, 154 (Kabat) 160, 164, 54 (Chothia) 169, 173, 154 (AbM) | 201, 208, 215, 220 | 263 | 176, 181, 190 (Kabat) 176, 181, 190 (Chothia) 176, 181, 190 (AbM) | 225, 230, 239, 244 | 274  348 |

TABLE E2-continued

Sequence identifier (SEQ ID NO) for Exemplary Clones

| | Heavy Chain | | | Light Chain | | | scFv | |
|---|---|---|---|---|---|---|---|---|
| Clone # | $V_H$ | CDR-H1, CDR-H2, CDR-H3 | $V_H$ FR (FR1, 2, 3, 4 Kabat) | $V_L$ | CDR-L1, CDR-L2, CDR-L3 | $V_L$ FR (FR1, 2, 3, 4, Kabat) | aa | nt |
| BCMA-20 | 254 | 3, 6, 155 (Kabat) 15, 18, 155 (Chothia) 22, 25, 155 (AbM) | 202, 209, 216, 70 | 264 | 177, 182, 191 (Kabat) 177, 182, 191 (Chothia) 177, 182, 191 (AbM) | 226, 231, 240, 245 | 275 | 349 |
| BCMA-21 | 255 | 2, 5, 156 (Kabat) 13, 17, 156 (Chothia) 20, 24, 156 (AbM) | 203, 65, 68, 70 | 265 | 174, 179, 192 (Kabat) 174, 179, 192 (Chothia) 174, 179, 192 (AbM) | 222, 228, 241, 246 | 276 | 350 |
| BCMA-22 | 256 | 2, 5, 157 (Kabat) 13, 17, 157 (Chothia) 20, 24, 157 (AbM) | 60, 65, 68, 70 | 266 | 178, 183, 193 (Kabat) 178, 183, 193 (Chothia) 178, 183, 193 (AbM) | 227, 232, 242, 246 | 277 | 351 |
| BCMA-23 | 256 | 2, 5, 157 (Kabat) 13, 17, 157 (Chothia) 20, 24, 157 (AbM) | 60, 65, 68, 70 | 267 | 178, 183, 194 (Kabat) 178, 183, 194 (Chothia) 178, 183, 194 (AbM) | 227, 232, 242, 246 | 278 | 352 |
| BCMA-24 | 518 | 2, 6, 376 (Kabat) 13, 18, 376 (Chothia) 20, 25, 376 (AbM) | 61, 65, 69, 71 | 534 | 30, 399, 415 (Kabat) 30, 399, 415 (Chothia) 30, 399, 415 (AbM) | 76, 85, 483, 508 | 558 | |
| BCMA-25 | 519 | 1, 4, 7 (Kabat) 12, 16, 7 (Chothia) 19, 23, 7 (AbM) | 436, 64, 67, 70 | 535 | 380, 400, 416 (Kabat) 380, 400, 416 (Chothia) 380, 400, 416 (AbM) | 446, 467, 484, 502 | 559 | 716, 717 |
| BCMA-26 | 115 | 2, 5, 10 (Kabat) 13, 17, 10 (Chothia) 20, 24, 10 (AbM) | 60, 65, 68, 71 | 536 | 33, 43, 421 (Kabat) 33, 43, 421 (Chothia) 33, 43, 421 (AbM) | 80, 89, 98, 108 | 560 | 718, 719 |
| BCMA-27 | 520 | 3, 6, 155 (Kabat) 15, 18, 155 (Chothia) 22, 25, 155 (AbM) | 434, 209, 216, 70 | 264 | 177, 182, 191 (Kabat) 177, 182, 191 (Chothia) 177, 182, 191 (AbM) | 226, 231, 240, 245 | 561 | |
| BCMA-28 | 521 | 3, 372, 376 (Kabat) 15, 514, 376 (Chothia) 22, 510, 376 (AbM) | 63, 209, 69, 444 | 537 | 381, 401, 417 (Kabat) 381, 401, 417 (Chothia) 381, 401, 417 (AbM) | 447, 468, 485, 508 | 562 | |
| BCMA-29 | 522 | 3, 6, 376 (Kabat) 15, 18, 376 (Chothia) 22, 25, 376 (AbM) | 63, 209, 69, 71 | 538 | 382, 402, 418 (Kabat) 382, 402, 418 (Chothia) 382, 402, 418 (AbM) | 448, 469, 486, 503 | 563 | |
| BCMA-30 | 523 | 3, 6, 377 (Kabat) 12, 18, 377 (Chothia) 509, 25, 377 (AbM) | 435, 209, 69, 71 | 539 | 383, 403, 419 (Kabat) 383, 403, 419 (Chothia) 383, 403, 419 (AbM) | 449, 470, 487, 104 | 564 | |
| BCMA-31 | 519 | 1, 4, 7 (Kabat) 12, 16, 7 (Chothia) 19, 23, 7 (AbM) | 436, 64, 67, 70 | 540 | 384, 39, 54 (Kabat) 384, 39, 54 (Chothia) 384, 39, 54 (AbM) | 450, 471, 93, 504 | 565 | |
| BCMA-32 | 524 | 2, 5, 10 (Kabat) 13, 17, 10 (Chothia) 20, 24, 10 (AbM) | 437, 65, 68, 71 | 541 | 385, 180, 58 (Kabat) 385, 180, 58 (Chothia) 385, 180, 58 (AbM) | 451, 472, 488, 109 | 566 | |
| BCMA-33 | 525 | 2, 373, 152 (Kabat) 13, 515, 152 (Chothia) 20, 511, 152 (AbM) | 199, 65, 69, 219 | 261 | 175, 180, 188 (Kabat) 175, 180, 188 (Chothia) 175, 180, 188 (AbM) | 224, 229, 237, 109 | 567 | |
| BCMA-34 | 526 | 3, 6, 11 (Kabat) 15, 18, 11 (Chothia) 22, 25, 11 (AbM) | 438, 209, 69, 71 | 542 | 386, 404, 420 (Kabat) 386, 404, 420 (Chothia) 386, 404, 420 (AbM) | 452, 84, 489, 504 | 568 | |
| BCMA-35 | 527 | 2, 5, 378 (Kabat) 13, 17, 378 (Chothia) 20, 24, 378 (AbM) | 61, 65, 69, 70 | 543 | 33, 43, 421 (Kabat) 33, 43, 421 (Chothia) 33, 43, 421 (AbM) | 453, 89, 98, 505 | 569 | |
| BCMA-36 | 528 | 2, 5, 9 (Kabat) 13, 17, 9 (Chothia) 20, 24, 9 (AbM) | 199, 65, 69, 70 | 544 | 387, 405, 422 (Kabat) 387, 405, 422 (Chothia) 387, 405, 422 (AbM) | 454, 473, 490, 109 | 570 | |
| BCMA-37 | 529 | 2, 5, 9 (Kabat) 13, 17, 9 (Chothia) 20, 24, 9 (AbM) | 61, 65, 441, 70 | 545 | 388, 406, 423 (Kabat) 388, 406, 423 (Chothia) 388, 406, 423 (AbM) | 455, 474, 491, 109 | 571 | |
| BCMA-38 | 528 | 2, 5, 9 (Kabat) 13, 17, 9 (Chothia) 20, 24, 9 (AbM) | 199, 65, 69, 70 | 546 | 388, 407, 424 (Kabat) 388, 407, 424 (Chothia) 388, 407, 424 (AbM) | 456, 474, 492, 109 | 572 | |
| BCMA-39 | 522 | 3, 6, 376 (Kabat) 15, 18, 376 (Chothia) 22, 25, 376 (AbM) | 63, 209, 69, 71 | 547 | 389, 408, 425 (Kabat) 389, 408, 425 (Chothia) 389, 408, 425 (AbM) | 457, 475, 493, 103 | 573 | |
| BCMA-40 | 256 | 2, 5, 157 (Kabat) 13, 17, 157 (Chothia) 20, 24, 157 (AbM) | 60, 65, 68, 70 | 548 | 390, 183, 193 (Kabat) 390, 183, 193 (Chothia) 390, 183, 193 (AbM) | 227, 232, 242, 108 | 574 | |
| BCMA-41 | 530 | 2, 374, 9 (Kabat) 13, 516, 9 (Chothia) 20, 512, 9 (AbM) | 199, 65, 68, 70 | 549 | 391, 409, 426 (Kabat) 391, 409, 426 (Chothia) 391, 409, 426 (AbM) | 458, 476, 494, 109 | 575 | 584 |
| BCMA-42 | 531 | 1, 4, 7 (Kabat) 12, 16, 7 (Chothia) 19, 23, 7 (AbM) | 439, 64, 67, 70 | 550 | 392, 40, 427 (Kabat) 392, 40, 427 (Chothia) 392, 40, 427 (AbM) | 459, 477, 495, 506 | 576 | |

TABLE E2-continued

Sequence identifier (SEQ ID NO) for Exemplary Clones

| Clone # | Heavy Chain | | | Light Chain | | | scFv | |
|---|---|---|---|---|---|---|---|---|
| | $V_H$ | CDR-H1, CDR-H2, CDR-H3 | $V_H$ FR (FR1, 2, 3, 4 Kabat) | $V_L$ | CDR-L1, CDR-L2, CDR-L3 | $V_L$ FR (FR1, 2, 3, 4, Kabat) | aa | nt |
| BCMA-44 | 519 | 1, 4, 7 (Kabat) 12, 16, 7 (Chothia) 19, 23, 7 (AbM) | 436, 64, 67, 70 | 552 | 394, 39, 429 (Kabat) 394, 39, 429 (Chothia) 394, 39, 429 (AbM) | 461, 85, 93, 107 | 578 | |
| BCMA-45 | 110 | 1, 4, 7 (Kabat) 12, 16, 7 (Chothia) 19, 23, 7 (AbM) | 59, 64, 67, 70 | 553 | 395, 411, 430 (Kabat) 395, 411, 430 (Chothia) 395, 411, 430 (AbM) | 462, 479, 497, 105 | 579 | |
| BCMA-46 | 110 | 1, 4, 7 (Kabat) 12, 16, 7 (Chothia) 19, 23, 7 (AbM) | 59, 64, 67, 70 | 118 | 28, 39, 49 (Kabat) 28, 39, 49 (Chothia) 28, 39, 49 (AbM) | 74, 85, 93, 104 | 130 | |
| BCMA-47 | 533 | 2, 5, 10 (Kabat) 13, 17, 10 (Chothia) 20, 24, 10 (AbM) | 197, 65, 443, 445 | 554 | 396, 412, 431 (Kabat) 396, 412, 431 (Chothia) 396, 412, 431 (AbM) | 463, 480, 498, 108 | 580 | |
| BCMA-48 | 115 | 2, 5, 10 (Kabat) 13, 17, 10 (Chothia) 20, 24, 10 (AbM) | 60, 65, 68, 71 | 555 | 396, 412, 58 (Kabat) 396, 412, 58 (Chothia) 396, 412, 58 (AbM) | 464, 480, 499, 109 | 581 | |
| BCMA-49 | 524 | 2, 5, 10 (Kabat) 13, 17, 10 (Chothia) 20, 24, 10 (AbM) | 437, 65, 68, 71 | 556 | 397, 413, 432 (Kabat) 397, 413, 432 (Chothia) 397, 413, 432 (AbM) | 465, 481, 500, 109 | 582 | |
| BCMA-51 | 519 | 1, 4, 7 (Kabat) 12, 16, 7 (Chothia) 19, 23, 7 (AbM) | 436, 64, 67, 70 | 557 | 398, 414, 433 (Kabat) 398, 414, 433 (Chothia) 398, 414, 433 (AbM) | 466, 482, 501, 508 | 583 | |

Exemplary clones were purified and titrated, and their binding affinities ($EC_{50}$) to hBMCA was tested: BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-14, BCMA-15, BCMA-16, BCMA-17, BCMA-18, BCMA-19, BCMA-20, BCMA-21, BCMA-22, BCMA-23, BCMA-24, BCMA-25, BCMA-26, BCMA-27, BCMA-28 and BCMA-29. Other anti-BCMA scFv antibodies also were assessed (see Table E3), such as scFvs containing $V_H$ and $V_L$ sequences of antibodies described in WO2016090327, and scFvs containing $V_H$ and $V_L$ sequences of BCMA antibodies described in WO2010104949.

TABLE E3

Sequence identifier (SEQ ID NO) for Exemplary Anti-BCMA Antibodies

| Clone # | Heavy Chain | | | Light Chain | | | scFv | |
|---|---|---|---|---|---|---|---|---|
| | $V_H$ | CDR-H1, CDR-H2, CDR-H3 | $V_H$ FR (FR1, 2, 3, 4 Kabat) | $V_L$ | CDR-L1, CDR-L2, CDR-L3 | $V_L$ FR (FR1, 2, 3, 4, Kabat) | aa | nt |
| BCMA-52 | 609 | 507, 513, 517 (Kabat) 532, 551, 517 (Chothia) 577, 587, 517 (AbM) 604, 605, 606 | | 610 | 589, 590, 591 (Kabat) 589, 590, 591 (Chothia) 589, 590, 591 (AbM) 607, 608, 591 | | 442 | 647, 440 |
| BCMA-55 | 617 | 593, 594, 595 (Kabat) 596, 597, 595 (Chothia) 598, 599, 595 (AbM) 611, 612, 613 | | 618 | 601, 602, 603 (Kabat) 601, 602, 603 (Chothia) 601, 602, 603 (AbM) 614, 615, 603 | | 478 | 648, 460 |
| BCMA-C1, $V_H$-$V_L$ | 324 | 288, 290, 292 (Kabat) 294, 296, 292 (Chothia) 298, 300, 292 (AbM) | 308, 310, 312, 314 | 326 | 302, 304, 306 (Kabat) 302, 304, 306 (Chothia) 302, 304, 306 (AbM) | 316, 318, 320, 322 | 585 | |
| BCMA-C1, $V_L$-$V_H$ | 324 | 288, 290, 292 (Kabat) 294, 296, 292 (Chothia) 298, 300, 292 (AbM) | 308, 310, 312, 314 | 326 | 302, 304, 306 (Kabat) 302, 304, 306 (Chothia) 302, 304, 306 (AbM) | 316, 318, 320, 322 | 328 | |
| BCMA-C2, $V_H$-$V_L$ | 325 | 289, 291, 293 (Kabat) 295, 297, 293 (Chothia) 299, 301, 293 (AbM) | 309, 311, 313, 315 | 327 | 303, 305, 307 (Kabat) 303, 305, 307 (Chothia) 303, 305, 307 (AbM) | 317, 319, 321, 323 | 329 | |
| BCMA-C2, $V_L$-$V_H$ | 325 | 289, 291, 293 (Kabat) 295, 297, 293 (Chothia) 299, 301, 293 (AbM) | 309, 311, 313, 315 | 327 | 303, 305, 307 (Kabat) 303, 305, 307 (Chothia) 303, 305, 307 (AbM) | 317, 319, 321, 323 | 586 | |

Example 3: Generation of Chimeric Antigen Receptors (CARs) Against BCMA and Cells Expressing Anti-BCMA CARs Polynucleotides encoding exemplary chimeric antigen receptors (CARs), each containing a human anti-BCMA scFv antigen-binding domain, were generated. Among the human anti-BCMA scFvs were those described in Example 2. Also among the CARs generated were CARs containing scFvs containing VH and VL sequences of antibodies described in WO2016090327. Also generated were anti-BCMA CARs containing scFvs with VH and VL sequences of BCMA antibodies described in WO2010104949. In some cases of the scFv, the $V_H$ was amino-terminal to the $V_L$ and in some cases the $V_L$ was amino-terminal to the $V_H$. The scFv regions in generated CARs are set forth in Table E4.

Specifically, the exemplary polynucleotide CAR constructs contained nucleic acid encoding a human IgG-kappa signaling sequence (SEQ ID NO: 619, encoding SEQ ID NO: 620), a human anti-BCMA scFv (SEQ ID NOS: 128-130, 132, 133, 136, 137, 269, 273-277, 442, 478 and 558-563), a spacer (such as a spacer containing a modified IgG4-hinge $C_H2$-$C_H3$ (SEQ ID NO:621, encoding SEQ ID NO:649) (which spacer may in some instances be referred to as "LS") or, in some cases, a shorter spacer (which may be referred to as "SS"), such as one derived from an IgG hinge region, such as an IgG4-derived hinge region or modified form thereof, or derived from a CD28 extracellular domain; a human CD28 transmembrane domain; a human 4-1BB-derived intracellular co-signaling sequence; and a human CD3-zeta derived intracellular signaling domain. Exemplary spacers included those derived from an IgG4 hinge region (such as those encoded by, e.g., SEQ ID NO:364, and/or containing the amino acid sequence of SEQ ID NO: 363) and CD28 ectodomain-derived spacers such as those encoded by, e.g., the sequence of SEQ ID NO: 629 or those having an amino acid sequence of SEQ ID NO: 630.

A polynucleotide encoding another CAR construct also was generated containing nucleic acid encoding a human IgG-kappa signal sequence (SEQ ID NO: 619, encoding SEQ ID NO: 620), a mouse anti-BCMA scFv (SEQ ID NO: 328 (BCMA-C1; $V_L$—$V_H$), 329 (BCMA-C2; $V_H$—$V_L$), 585 (BCMA-C1; $V_H$—$V_L$), or 586 (BCMAC-2; $V_L$—$V_H$)), a spacer (SEQ ID NO:621, encoding SEQ ID NO:649), a human CD28 transmembrane domain, a human 4-1BB-derived intracellular co-signaling sequence, and a CD3-zeta derived intracellular signaling domain.

TABLE E4

Sequences for exemplary $V_H$-$V_L$ scFv clones (SEQ ID NO)

| Construct | Heavy Chain Variable ($V_H$) Region Amino Acid | Light Chain Variable ($V_L$) Region Amino Acid | VH-VL or VL-VH scFv Nucleotide | VH-VL or VL-VH scFv Amino Acid |
|---|---|---|---|---|
| BCMA-1 | 110 | 116 | 330 | 128 |
| BCMA-2 | 111 | 117 | 331 | 129 |
| BCMA-3 | 110 | 118 | 332 | 130 |
| BCMA-5 | 110 | 120 | 334 | 132 |
| BCMA-6 | 110 | 121 | 335 | 133 |
| BCMA-9 | 112 | 124 | 338 | 136 |
| BCMA-10 | 113 | 125 | 339 | 137 |
| BCMA-14 | 248 | 258 | 343 | 269 |
| BCMA-18 | 252 | 262 | 347 | 273 |
| BCMA-19 | 253 | 263 | 348 | 274 |
| BCMA-20 | 254 | 264 | 349 | 275 |

TABLE E4-continued

Sequences for exemplary $V_H$-$V_L$ scFv clones (SEQ ID NO)

| Construct | Heavy Chain Variable ($V_H$) Region Amino Acid | Light Chain Variable ($V_L$) Region Amino Acid | VH-VL or VL-VH scFv Nucleotide | VH-VL or VL-VH scFv Amino Acid |
|---|---|---|---|---|
| BCMA-21 | 255 | 265 | 350 | 276 |
| BCMA-22 | 256 | 266 | 351 | 277 |
| BCMA-23 | 256 | 267 | 352 | 278 |
| BCMA-24 | 518 | 534 |  | 558 |
| BCMA-25 | 519 | 535 |  | 559 |
| BCMA-26 | 115 | 536 |  | 560 |
| BCMA-27 | 520 | 264 |  | 561 |
| BCMA-28 | 521 | 537 |  | 562 |
| BCMA-29 | 522 | 538 |  | 563 |
| BCMA-52 | 609 | 610 | 647 | 442 |
| BCMA-55 | 617 | 618 | 648 | 478 |
| BCMA-C1, VH-VL | 324 | 326 |  | 585 |
| BCMA-C1, VL-VH | 324 | 326 |  | 328 |
| BCMA-C2, VH-VL | 325 | 327 |  | 329 |
| BCMA-C2, VL-VH | 325 | 327 |  | 586 | cDNA clones encoding such CARs, were linked to a downstream ribosomal skip element (such as T2A-encoding sequence SEQ ID NO: 686 or 687, encoding SEQ ID NO: 654) followed by a truncated receptor-encoding sequence, and cloned into a lentiviral expression vector.

To generate anti-BCMA CAR-expressing T cells, T cells were isolated by immunoaffinity-based enrichment from leukapheresis samples from human donor subjects. Isolated T cells were activated and transduced with lentiviral vectors containing the respective polynucleotides encoding the anti-BCMA CARs. After transduction and expansion, CD4+ and CD8+ T cells were stained with an antibody specific for the truncated receptor and with a fluorescently labeled-recombinant human BCMA and analyzed by flow cytometry, confirming transduction of cells and expression of the anti-BCMA CARs.

Example 4: Assessment of Potential RNA Heterogeneity and Modification

RNA from cells transduced with exemplary anti-BCMA CARs as described in Example 3 were analyzed for heterogeneity by agarose gel electrophoresis, following reverse transcriptase polymerase chain reaction (RT-PCR) using primers specific to the promoter and the WPRE downstream in the 5' UTR and 3' UTR of the exemplary CAR transcripts. Multiple bands were observed for various anti-BCMA CAR constructs containing an exemplary spacer including a modified IgG $C_H2$-$C_H3$-hinge region (BCMA-LS CAR) (FIG. 1A), indicating RNA heterogeneity. Less RNA heterogeneity was observed for exemplary CARs containing a shorter spacer, such as that including a portion of a human CD28 extracellular region (see, e.g., BCMA-52-SS CAR).

In the nucleotide sequences encoding various BCMA-LS CARs were assessed for potential splice sites and modified in a conservative manner, including removal of potential predicted splice sites. The sequences prior to modification (starting sequence) and those following modification (optimized sequences) were subjected to analysis to assess the presence of potential cryptic splice sites. Splice donor sites and splice acceptor sites were evaluated independently. Exemplary splice donor and splice acceptor sites of the starting sequences of various regions of the construct were identified (e.g. in promoter region and long spacer region).

Exemplary splice donor sites and splice acceptor sites were identified within the long spacer region following initial codon optimization that had a splice site score of >0.7 (>70%), e.g. donor sites set forth in SEQ ID NO: 693 (splice site score of 0.96) and 708 (splice site score of 0.97), respectively. Modified constructs were generated containing additional modifications within regions assessed with a splice site score of >0.7 (>70%) following initial codon optimization (see, e.g., SEQ ID NO:855 for an exemplary initial codon-optimized spacer sequence) were made in order to reduce potential for unwanted splice sites. Among such regions further modified after codon optimization/splice site elimination were those within longer spacer region sequences, e.g. final optimized splice site eliminated (O/SSE) sequences of splice donor site and splice acceptor site is set forth in SEQ ID NOS: 662 and 672, respectively.

Figure 1B:
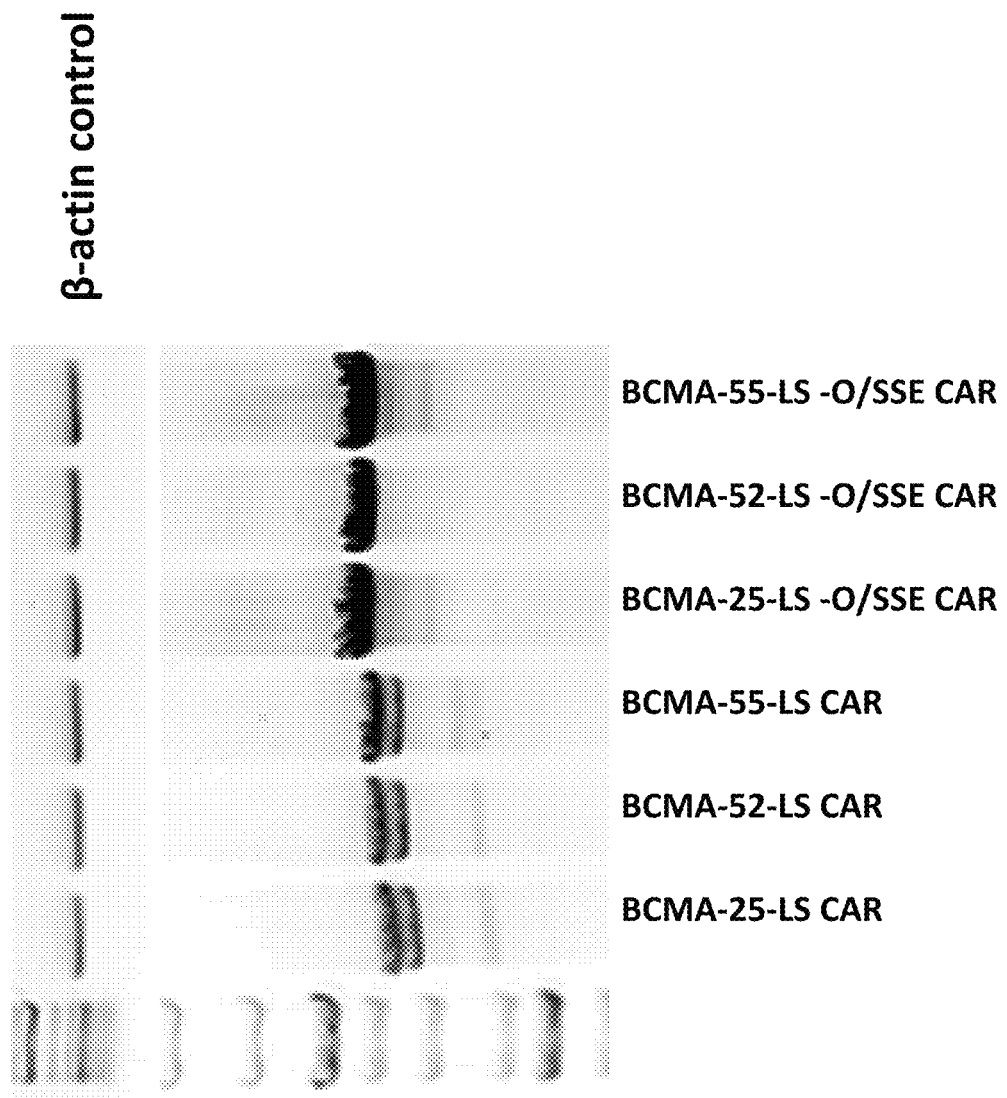

The modified sequences were constructed and tested for RNA heterogeneity as described above. Electrophoresis confirmed reduction of RNA heterogeneity. Analysis of BCMA-CAR constructs before and after splice site elimination demonstrated reduced RNA heterogeneity (FIG. 1B). Exemplary O/SSE CAR constructs were generated containing the modifications of the long spacer region, e.g. BCMA-23-LS-O/SSE CAR, BCMA-25-LS-O/SSE CAR, BCMA-26-LS-O/SSE CAR, BCMA-52-LS-O/SSE CAR, and BCMA-55-LS-O/SSE CAR.

Example 5: Assessment of CAR Expression and Function in Primary T Cells

Figure 2:
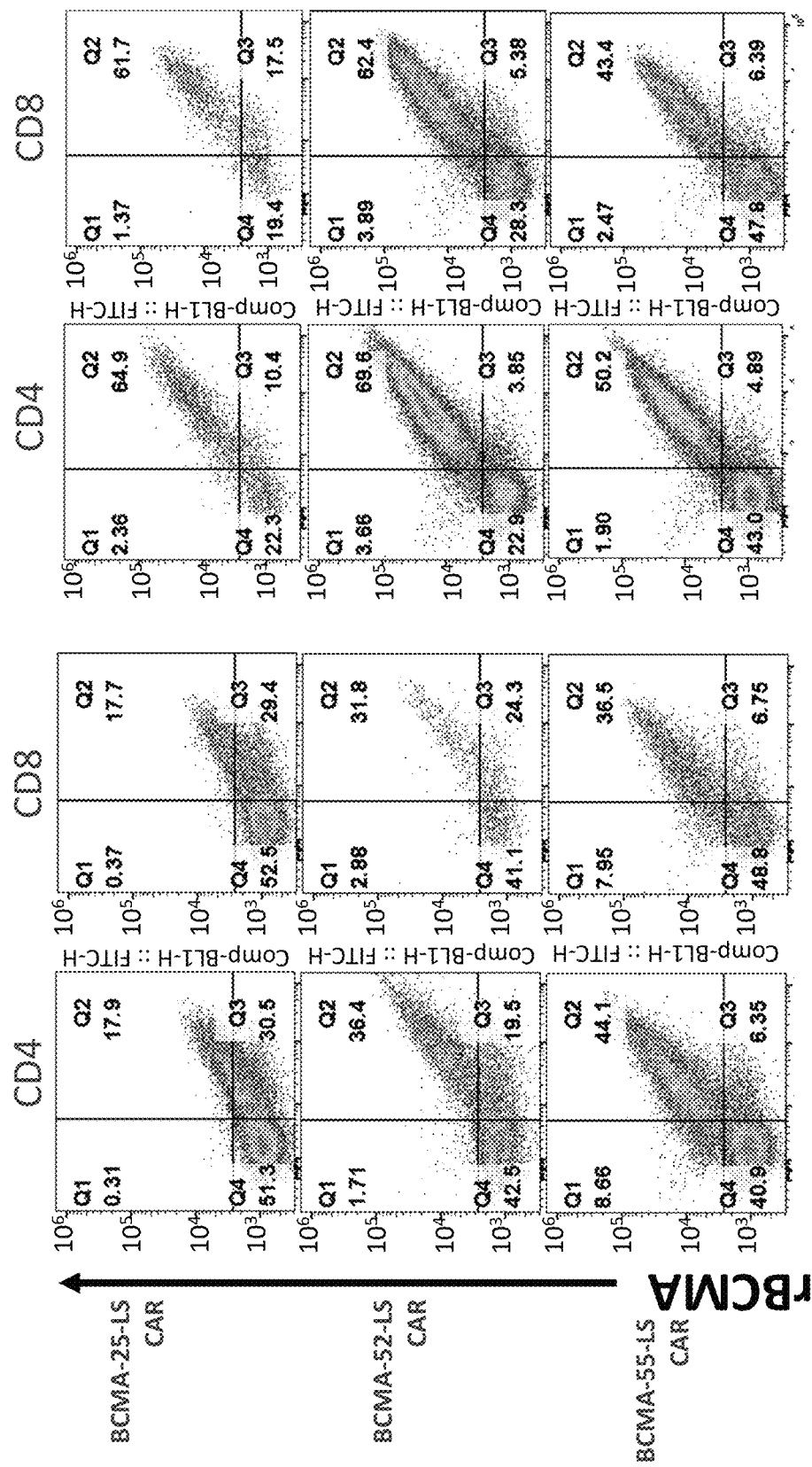
FIG. 2 depicts results of an assay assessing levels of BCMA-LS CAR expression on the surface of transduced T cells before (Non-SSE) and after (O/SSE) optimization and splice site elimination of the coding sequence.

Lentiviral constructs containing anti-BCMA CAR-encoding polynucleotides with starting and optimized sequences, respectively, as described in Example 3, were transduced into T cells and transduced cells were analyzed for transduction (based on expression of a surrogate marker) and for CAR expression based on binding to recombinant BCMA-Fc fusion protein by flow cytometry. A greater percentage of CD4+ and CD8+ T cells transduced using the optimized sequences, BCMA-52-LS-O/SSE CAR and BCMA-55-LS-O/SSE CAR, expressed the anti-BCMA CAR on the surface, compared to cells transduced to express the same corresponding CAR via the polynucleotide having the starting (non-SSE) sequence. Representative data are set forth in FIG. 2 and Table E5 below.

Example 6: Characterization of BCMA-52 and BCMA-55 scFvs

A. Immunohistochemistry Staining of Tissues

Cells and tissues expressing varying levels of BCMA were assessed by immunohistochemistry for binding of exemplary anti-BCMA antibodies. Binding domains (scFvs) of exemplary human-BCMA-targeted CARs, which had been fused to a mouse IgG1 Fc region peptide, were assessed for binding cells and tissues by immunohistochemistry.

B. Assessment of Binding Kinetics

A CAR with a BCMA-55-derived scFv binding domain, a modified IgG-derived $C_H2$-$C_H3$-hinge spacer, a CD28 transmembrane domain, and 41BB and CD3zeta endodomain, was expressed in a Jurkat T cell line. Kinetics of binding by the CAR to recombinant human BCMA-hFc (rhBCMA hFc) was assessed using a kinetics exclusion assay. Affinity of binding of an Fc fusion protein containing the scFv portion of the CAR (scFv-Fc) to recombinant human BCMA fusion protein was also assessed using a Biacore-based assay. In these studies, the $K_D$ for binding by the CAR and scFv-Fc fusion, respectively, were observed to be approximately 1 nM and 10 nM.

In a further experiment, Jurkat cells were transduced with a polynucleotide encoding a CAR with a BCMA-55-derived scFv binding domain and were cultured to a density of $\sim 2 \times 10^6$. The cells were harvested and spun at 1500 g for 15 minutes at 4° C. The cell pellet was washed and cells were resuspended and serially diluted in 20 nM or 1 nM biotinylated rhBCMA hFc (also referred to in this assay as the constant binding partner (CBP)). After equilibration, cells were spun down and supernatants were harvested for KinExa kinetic exclusion analysis. Briefly, supernatants from equilibrated BCMA-55-LS CAR O/SSE-expressing Jurkat cells containing rhBCMA hFc were flowed over a streptavidin bead flow cell to capture free biotinylated rhBCMA hFc. The rhBCMA was then detected using a secondary anti-hBCMA antibody that was fluorescently labelled. The absorbance of the detected rhBCMA hFc was recorded for each sample, and plotted against the number of cells in each dilution (Darling (2004) Assay Drug. Dev., 2:647-657). In this study, the $K_D$ for the interaction of the BCMA-55-LS-O/SSE CAR-expressing cells binding to rhBCMA hFc in this assay was determined to be approximately 1.46 nM, and the expression level (EL) was determined to be approximately 146,500 CARs per CAR-expressing Jurkat cell.

TABLE E5

Percentage of CD4+ and CD8+ T cells expressing anti-BCMA CAR

| | BCMA-25 | BCMA-25-O/SSE | BCMA-52 | BCMA-52-O/SSE | BCMA-55 | BCMA-55-O/SSE |
|---|---|---|---|---|---|---|
| CD4+ T cells | 17.9 | 64.9 | 36.4 | 69.6 | 44.1 | 50.2 |
| CD8+ T cells | 17.7 | 61.7 | 31.8 | 62.4 | 36.5 | 43.4 |

Figure 3:
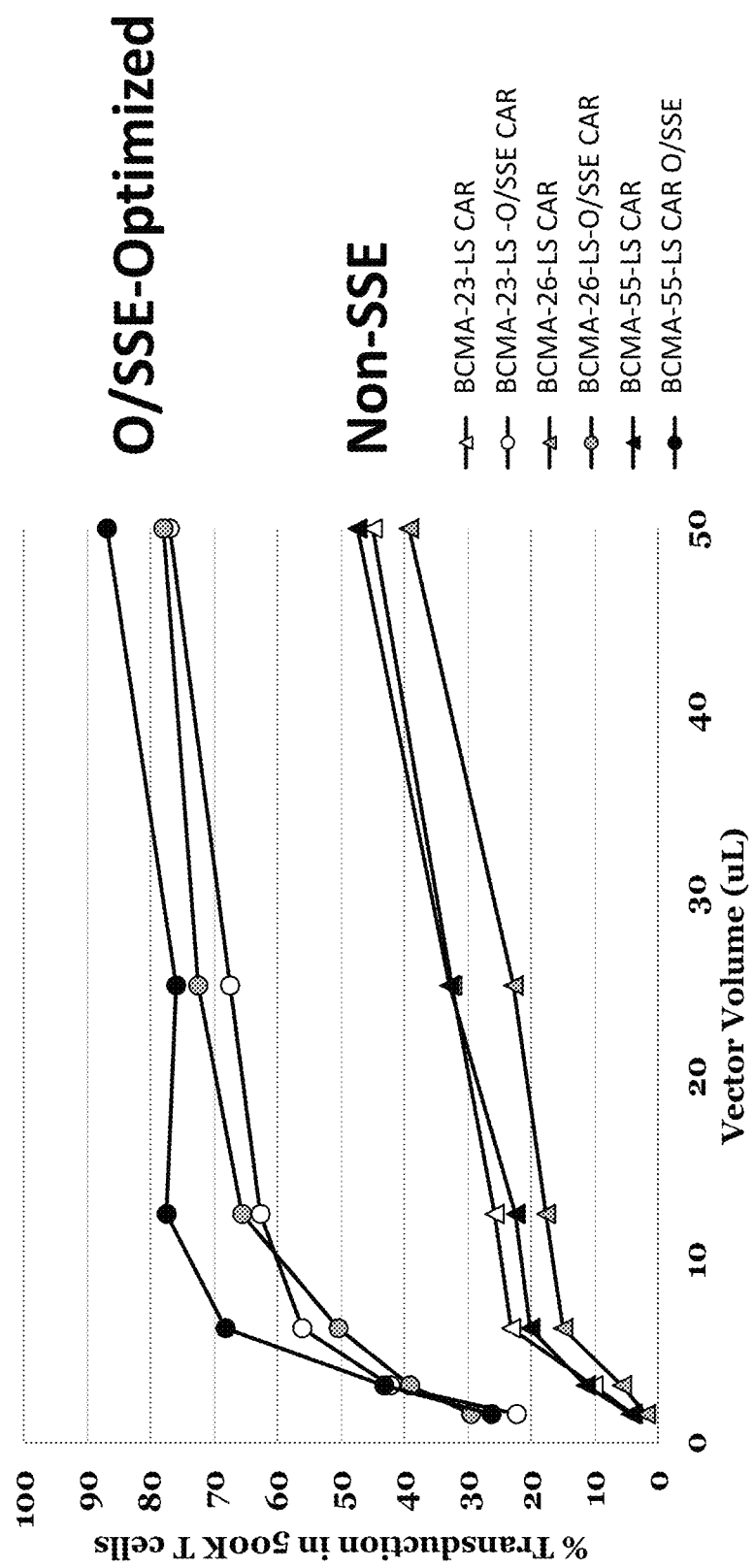
FIG. 3 depicts the comparison of transduction efficiency of lentiviral vectors encoding BMCA-LS CAR constructs and lentiviral vectors encoding BCMA-LS CAR constructs that have been codon optimized and modified to eliminate predicted splice sites (O/SSE).

Various volumes of viral preparations containing lentiviral vectors encoding CAR constructs, BCMA-23-LS CAR, BCMA 26-LS CAR, BCMA 55-LS CAR and BCMA 55-LS-O/SSE CAR, were used to transduce 500,000 donor-derived primary human T cells and transduction efficiency was compared. The percent transduction of T-cells was increased following transduction by optimized sequences (FIG. 3, circles) compared to starting sequences (FIG. 3, triangles).

C. Selectivity of BCMA-55 scFv-Fc

A membrane proteome array (MPA) assay was used to assess binding specificity of the BCMA-55-derived binding domain, using an scFv-Fc fusion protein. The interactions of BCMA-55-Fc to HEK293 cells expressing over 4400 unique human extracellular proteins, representing over 85% of the human extracellular proteome, and a fluorescent protein were evaluated using the Retrogenix™ platform. Fluorescent protein was detected to verify transfection, and CTLA4-Fc (tested at 0.2 μg/mL), containing a matched Fc, was also used to screen for CD86 as a positive control. An initial screening involved an scFv binding assay for BCMA-55-scFv against the full protein panel. A follow-up confirmation screen was then performed retesting the interaction of BCMA-55-Fc with a subset of potential hits identified in the initial screen. BCMA was identified as the only strong, specific hit in this assay, consistent with a conclusion that this binding domain is highly selective for BCMA over other extracellular proteins. Some low level signal was observed for Cathepsin G (CTSG), but was observed not to confer functional activity (see Example 16).

Example 7: In Vitro Functional Assessment of T Cells Engineered to Express Various Anti-BCMA Chimeric Antigen Receptor (CARs)

Genetically engineered human T cells expressing various exemplary anti-BCMA CARs were assessed in vitro following co-culture with BCMA-expressing target cells. T cells were transduced with BCMA-52-LS CAR, BCMA-55-LS CAR, BCMA-52-LS-O/SSE CAR, or BCMA-55-LS-O/SSE CAR). Responses were compared to reference anti-BCMA CAR-expressing cells as positive control or mock-processed cells as negative control.

A. Cytolytic Activity Against Target Cells

BCMA-expressing target cells were incubated with T cells expressing the BCMA-52-LS CAR, BCMA-55-LS CAR, or a reference anti-BCMA CAR at an effector to target (E:T) ratio of 5:1, 2.5:1, 1.25:1 and 0.65:1. As a control, target cells were incubated with T cells not expressing a CAR (mock control). Specifically, BCMA-transduced K562 cells (K562/BCMA, BCMA$^{high}$) or RPMI 8226 cells (BCMA$^{low}$ human multiple myeloma cell line) were used as targets for lysis. Target cells were labeled with NucLight Red (NLR) to permit tracking of target cells by microscopy. Cytolytic activity was assessed by measuring the loss of viable target cells over a period of between 24 and 72 hours, as determined by red fluorescent signal (using the IncuCyte® Live Cell Analysis System, Essen Bioscience). Percent lysis (% Lysis) was normalized to the lysis that occurred in target cells incubated with mock-processed T cells. As shown in FIG. 4A, the anti-BCMA CAR-expressing T cells exhibited antigen-specific cytolytic activity against BCMA+ cells. The magnitude of cell lysis differed depending on the particular cell line and CAR.

Figure 4B:
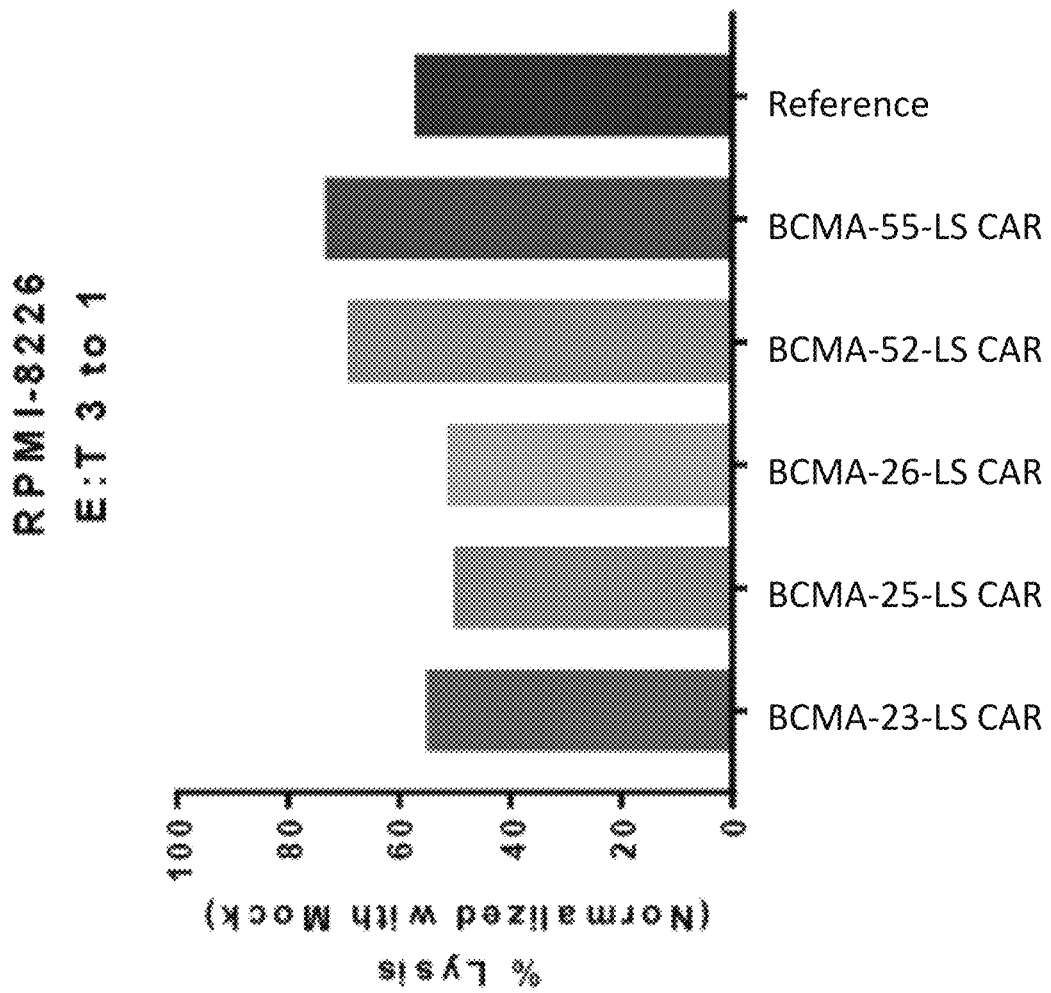
FIG. 4B depicts the cytolytic activity of several BMCA-LS CAR-expressing T cells against RPMI-8226 cells at an E:T ratio of 3:1.

In a separate experiment, cytolytic activity was tested with RPMI 8226 target cells at a E:T ratio of 3:1. As shown in FIG. 4B, BCMA-52-LS- and BCMA-55-LS-CAR-expressing cells showed approximately 70% lysis, normalized to the lysis by mock-processed cells not expressing a CAR, whereas the cells expressing the CAR containing the reference anti-BCMA antibody binding domain showed approximately 50% lysis. Thus, the results showed that cytolytic activity of cells engineered to express BCMA-52- or BCMA-55-CARs was similar to or higher than that of the reference binding domain-containing CAR.

Figure 4C:
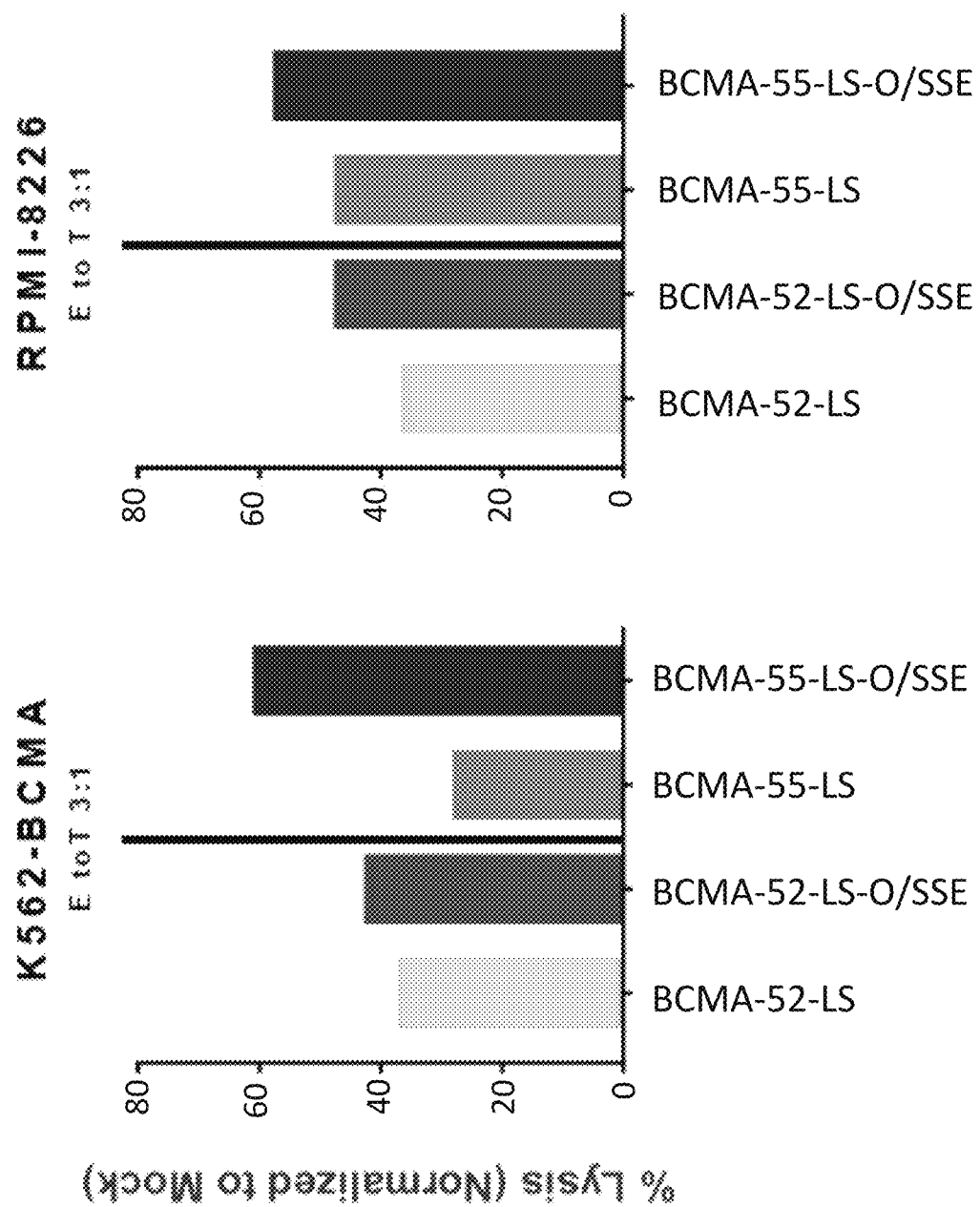
FIG. 4C and FIG. 4D depict the cytolytic activity of non-optimized BCMA-LS CAR-expressing T cells and optimized (O/SSE) BCMA-LS CAR-expressing T cells on various BCMA-expressing cell lines.
Figure 4D:
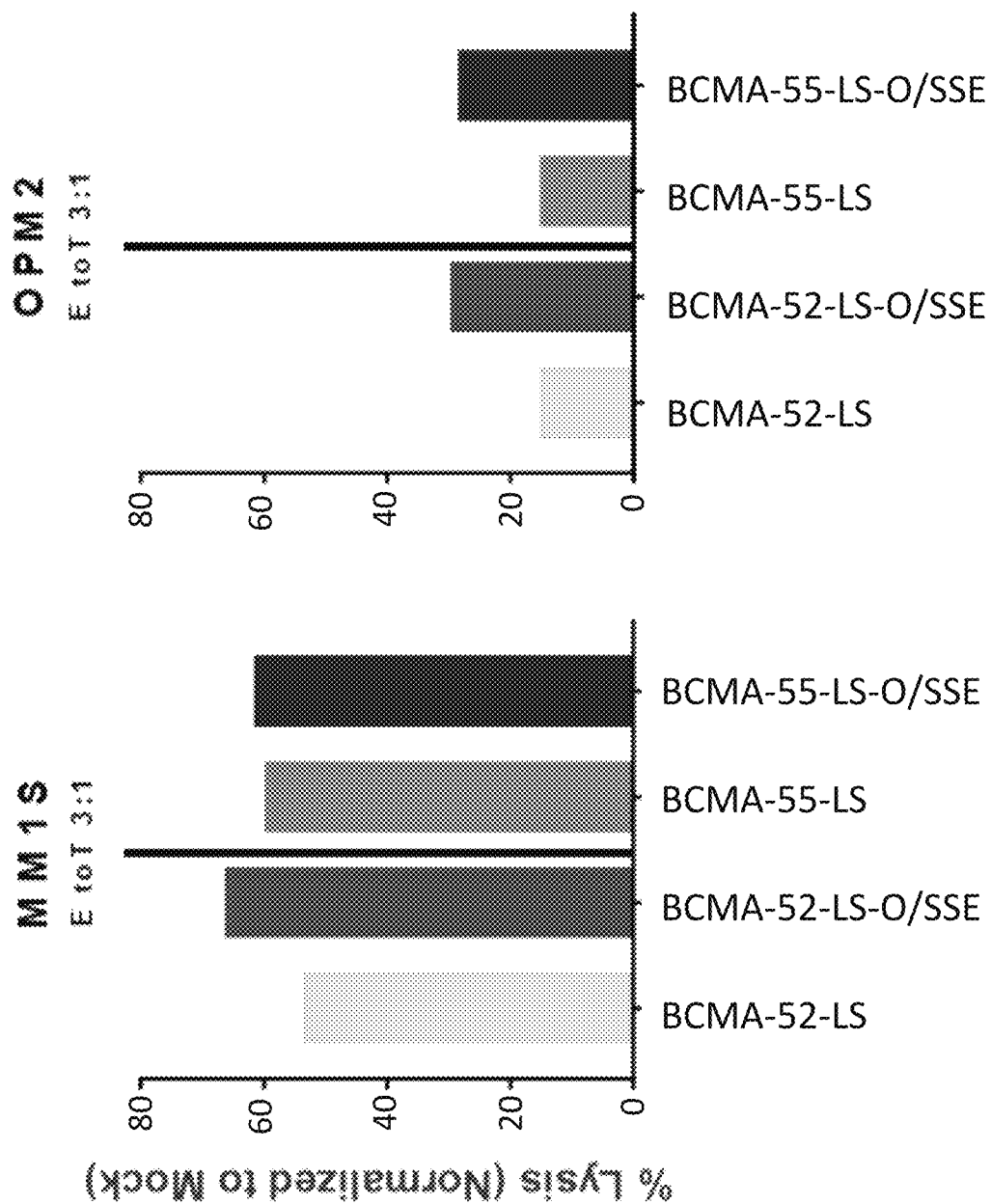

To compare cytolytic activity of T cells engineered with the same CAR encoded by an unmodified CAR construct or an optimized CAR construct, T cells were engineered to express an anti-BCMA CAR using a viral vector containing either an unmodified polynucleotide construct (BCMA-52-LS CAR and BCMA-55-LS CAR) or an optimized polynucleotide construct (BCMA-52-LS-O/SSE CAR and BCMA-55-LS-O/SSE CAR). Cytolytic activity of the engineered cells was assayed substantially as described above. The CAR-expressing T cells were incubated with target cells, K562-BCMA, RPMI 8226, MM1.S cells (BCMA$^{med}$ human multiple myeloma cell line) or OPM2 cells (BCMA$^{med}$ human multiple myeloma cell line) target cells, at an E:T ratio of 3:1. As shown in FIG. 4C and FIG. 4D, CAR-expressing cells transduced with a CO/SSE CAR construct exhibited greater cytolytic activity compared to cells transduced with the corresponding unmodified construct.

B. Cytokine Release

Cytokine release was assessed following incubation of the various anti-BCMA CAR-expressing cells with antigen-expressing target cells.

Figure 5A:
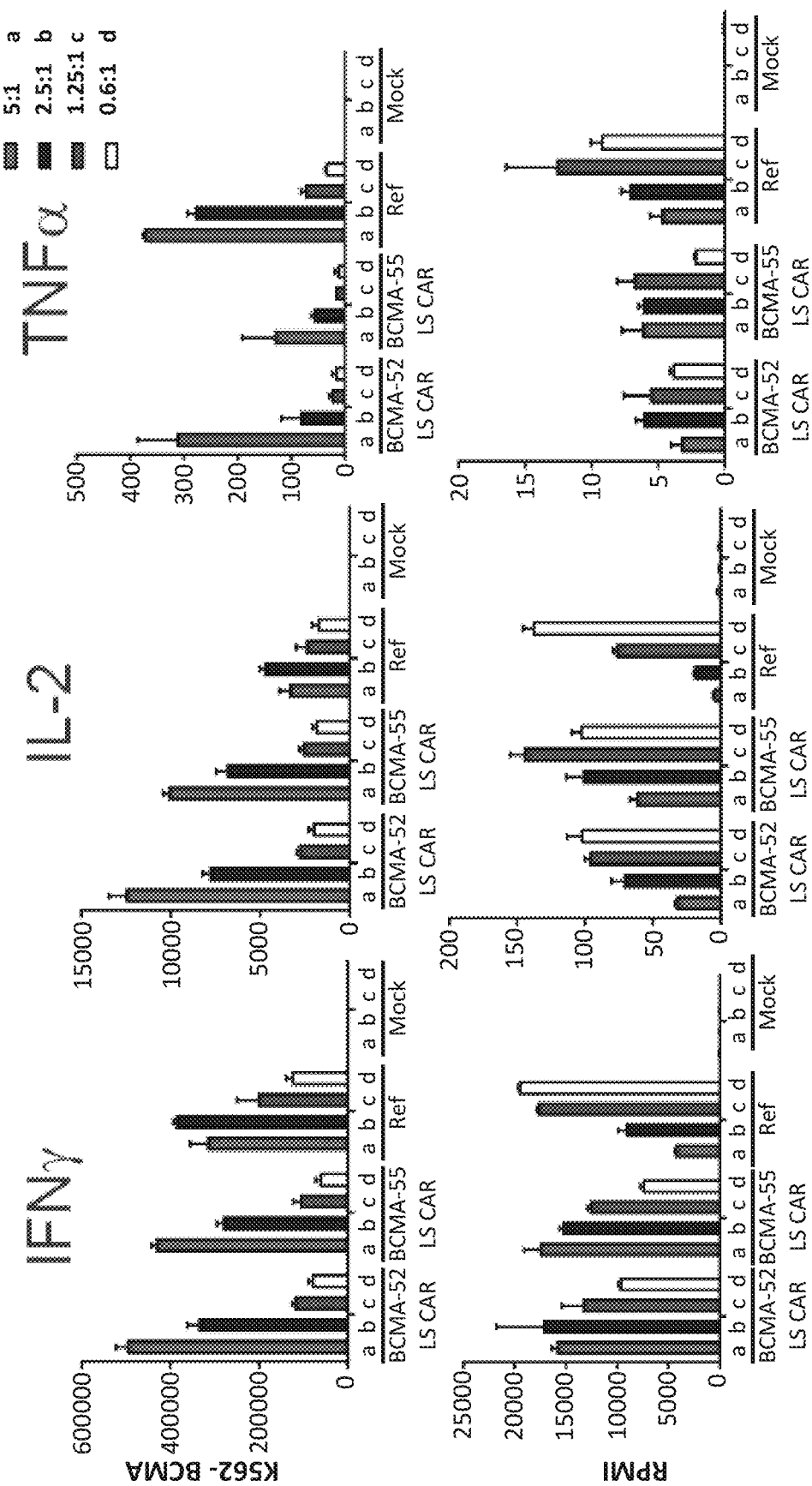
FIG. 5A depicts results of an assay assessing IFNγ, IL-2, and TNFα cytokine release of BMCA-LS CAR-expressing T cells in response to incubation with cell lines that express high (K562/BCMA) or low (RPMI 8226) levels of BCMA at several effector:target cell (E:T) ratios (5:1, 2.5:1, 1.25:1 and 0.6:1 indicated as a, b, c and d, respectively, in the figure).

BCMA-expressing target cells, K562/BCMA or RPMI 8226 cells, were incubated with T cells expressing the BCMA-52-LS CAR, BCMA-55-LS CAR, or a reference binding domain-containing anti-BCMA CAR at an E:T ratio of 5:1, 2.5:1, 1.25:1 or 0.6:1. As a control, target cells were incubated with T cells not expressing a CAR (mock control). The co-cultured cells were incubated for about 24 hours, and then supernatants were collected for measurement of IFN-γ, TNF-α and IL-2, using a multiplex cytokine immunoassay. As shown in FIG. 5A, the tested anti-BCMA CAR-expressing T cells produced cytokines following antigen stimulation.

Figure 5B:
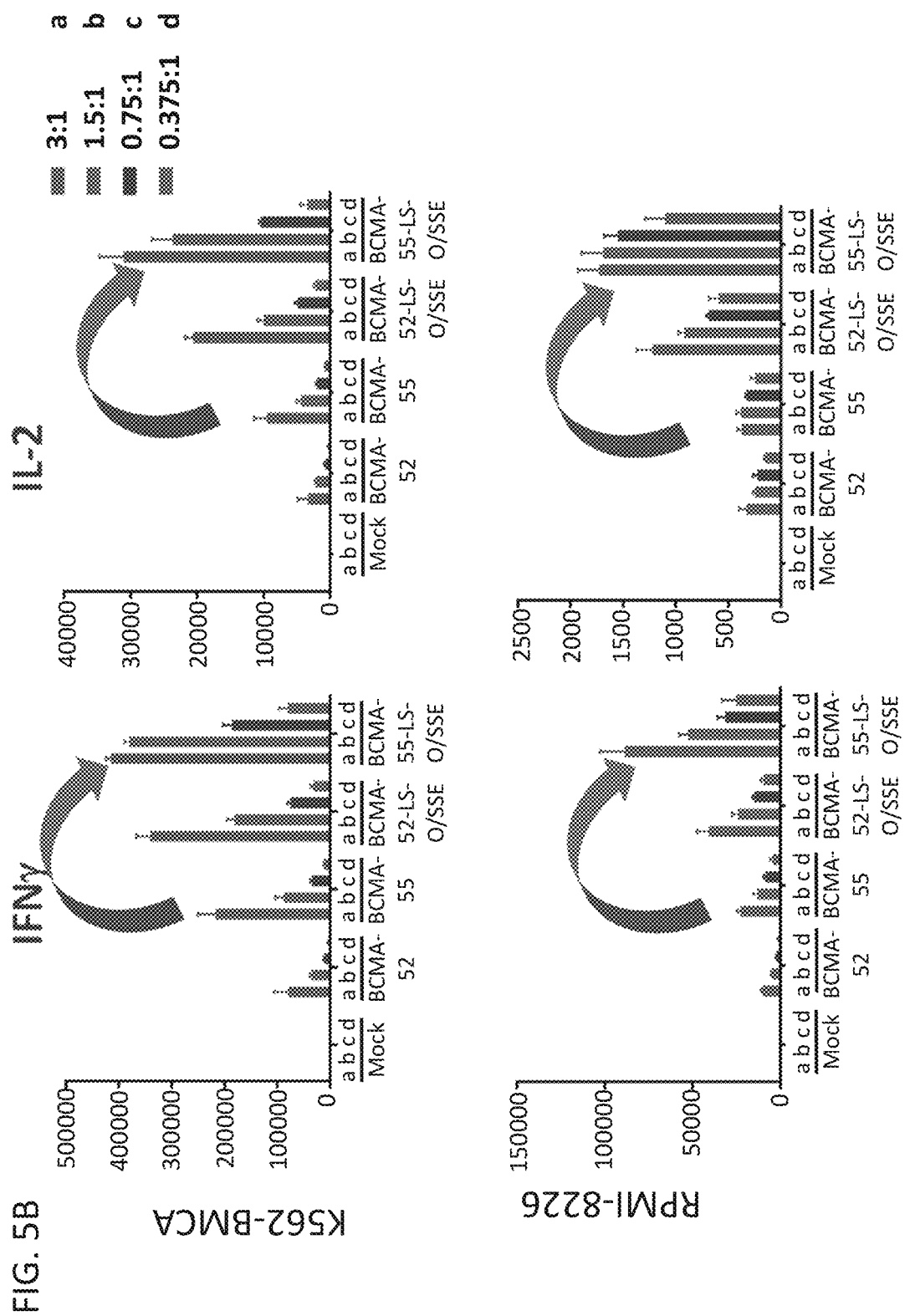
FIG. 5B depicts the IFNγ, IL-2, and TNFα cytokine release of non-optimized BMCA-LS CAR-expressing T cells and optimized (O/SSE) BCMA-LS CAR-expressing T cells in response to incubation with BCMA-expressing K562/BCMA and RPMI 8226 cells at different E:T ratios (3:1, 1.5:1, 0.75:1 and 0.375:1 indicated as a, b, c and d, respectively, in the figure).

To assess antigen-dependent cytokine production of T cells engineered with the same CAR encoded by an unmodified CAR construct or an optimized CAR construct, T cells were engineered to express an anti-BCMA CAR using a viral vector containing either an unmodified polynucleotide construct (BCMA-52-LS CAR and BCMA-55-LS CAR) or an optimized polynucleotide construct (BCMA-52-LS-O/SSE CAR and BCMA-55-LS-O/SSE CAR). CAR-expressing T cells were incubated with target cells, either K562/BCMA, RPMI 8226 cells, MIN1S (BCMA$^{med}$ human multiple myeloma cell line) or OPM2 cells (BCMA$^{med}$ human multiple myeloma cell line) target cells, at an E:T ratio of 3:1, 1.5:1, 0.75:1 and 0.375:1. Production of cytokines IFN-γ, TNF-α and IL-2 was assessed as described above. As shown in FIG. 5B, CAR-expressing cells transduced using O/SSE optimized constructs were observed to exhibit higher cytokine production compared to cells transduced with the corresponding unmodified (starting) construct.

C. Cytolytic Activity, Cytokine Release and Proliferation in Response to Targets Expressing Different Levels of Antigen on their Surfaces Cytolytic activity, cytokine release, and proliferation were assessed following incubation of BCMA-55-LS-O/SSE CAR-expressing T cells with BCMA-expressing cells that expressed different levels of BCMA. All activity was evaluated in the presence or absence of soluble BCMA.

A 1:1 ratio of CD4+ and CD8+ primary T cells, harvested from two human donors (D#1 and D#2), were stimulated with CD3/CD28 beads and transduced with a lentiviral vector to stably express BMCA-55 CAR. Transduced cells were cultured in the presence of BCMA-expressing target cells at an E:T ratio of 1:3, 1:1 or 3:1. Mock-processed T cells from the same donors were also mixed with target cells for use as a control. The BCMA+ target cells, Daudi, RPMI-8226, and K562-BCMA cell, exhibited different levels of BCMA antigen-density of the surface (antigen density: Daudi (<1000 BCMA molecules/cell)<RPMI-8226<K562-BCMA) and were stained with carboxyfluorescein succinimidyl ester (CF SE) prior to incubation with the T cells. An equal number of target-negative cells, not expressing BCMA and stained with cell trace violet (CTV), were also included in the cultures with the T cells and BCMA+ target cells. After a 24 hour incubation, the remaining BCMA+ vs BCMA− target cells were measured by flow cytometry, and the degree of target cell lysis, indicative of cytotoxicity, was assessed.

Figure 6:
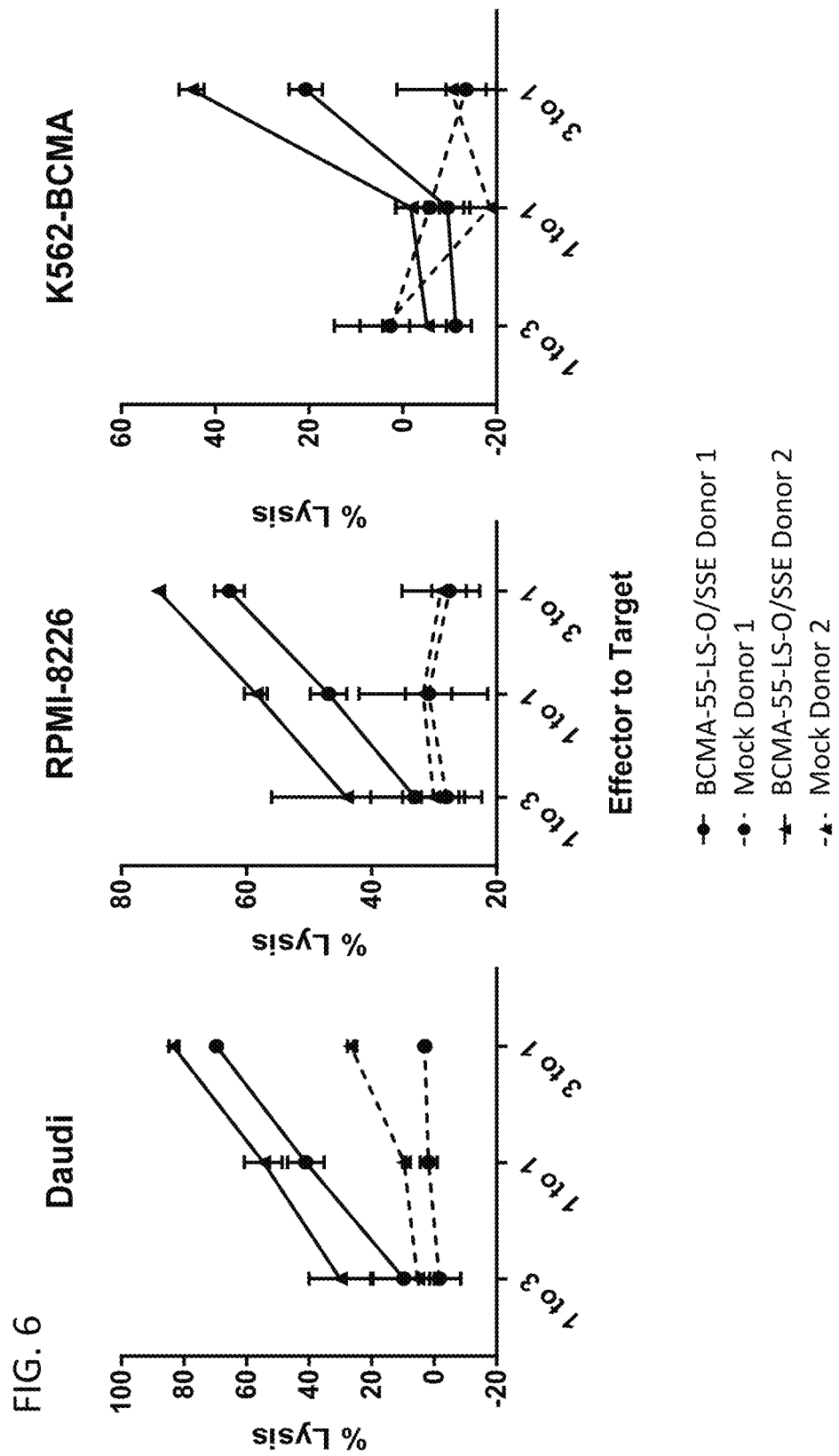
FIG. 6 depicts results of an assay assessing cytolytic activity following incubation of BCMA-55-LS-O/SSE CAR-expressing T cells, from two donors, with BCMA-expressing cells that express varying levels of BCMA.

BCMA-55-LS-O/SSE CAR T cells displayed similar cytolytic activity when cultured with target cells, regardless of BCMA expression levels (FIG. 6). Additionally, similar results were observed for target cells (NCI-H929) expressing a greater than 100,000 molecules per cell. Mock-processed T cells did not show activity against any of the BCMA+ target cell lines. Target cells negative for BCMA expression were not lysed by the BCMA-55-LS-O/SSE CAR T cells from any of the donors tested (data not shown).

Figure 7:
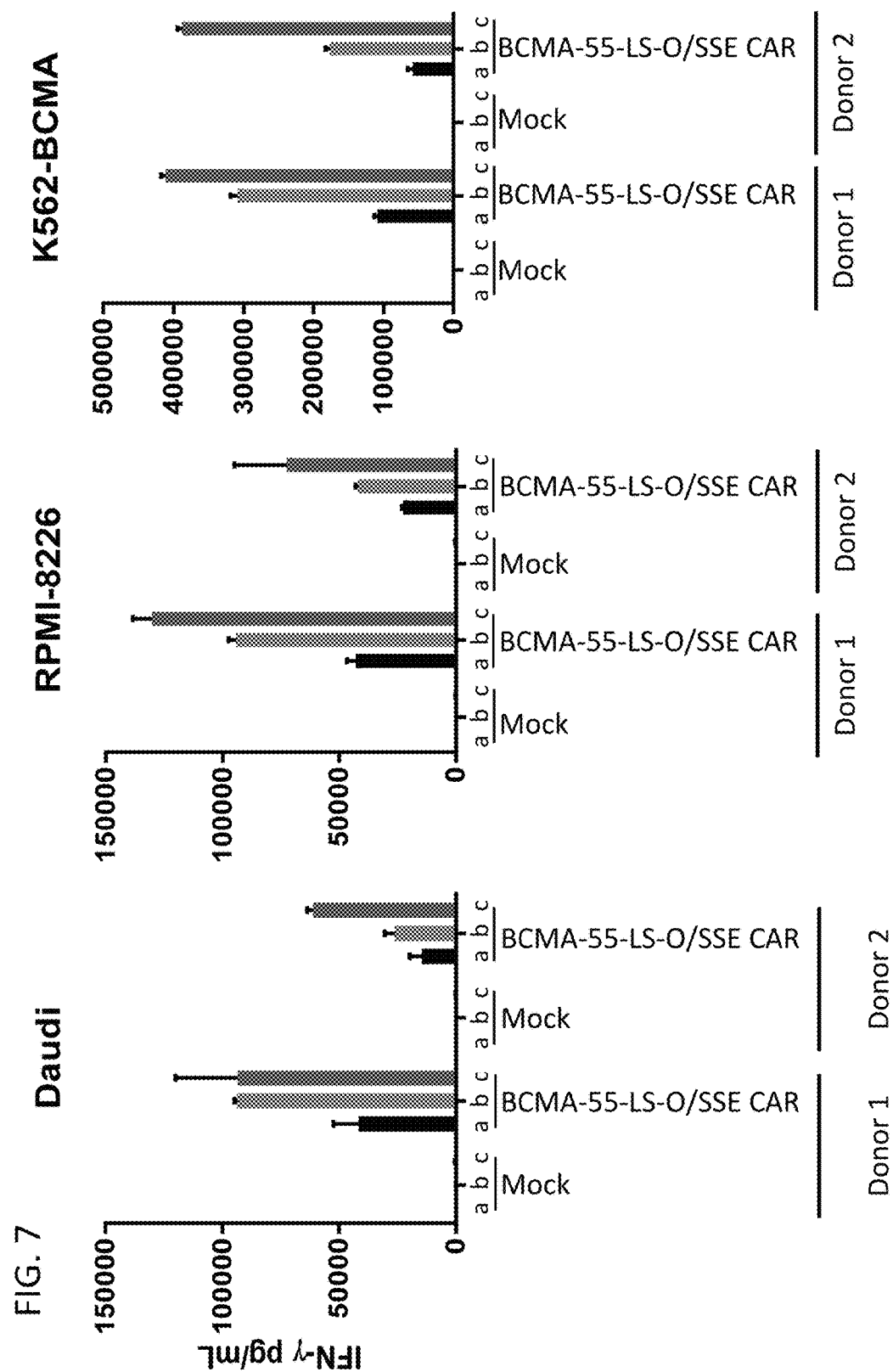
FIG. 7 depicts results of an assay assessing IFNγ release following incubation of BCMA-55-LS CAR O/SSE-expressing T cells, from two donors, with BCMA-expressing cells that express varying levels of BCMA.

The supernatants following the incubation were analyzed for accumulated IFN-γ, TNF-α, and IL-2 cytokines. Data were consistent with a conclusion that BCMA-55-LS-O/SSE CAR T cells had released a range of cytokines following engagement with BCMA-expressing target cells; with the level of cytokines released generally corresponding with increasing level of antigen (i.e., Daudi<RPMI 8226<K562-BCMA). Results for IFN-γ are shown in FIG. 7; similar data were observed for TNF-α and IL-2 (data not shown). BCMA-55-LS CAR O/SSE T cells did not release cytokines in response to BCMA-negative targets, nor did they express cytokines without any target cells present, demonstrating specificity for BCMA+ target cells and lack of tonic signaling.

Activity of BCMA-55-LS-O/SSE CAR-expressing T cells in the presence vs. absence of soluble BCMA was assessed. BCMA-55-LS-O/SSE CAR-expressing T cells were co-cultured with RPMI-8226 tumor cells, with recombinant BCMA-Fc, or with cell culture supernatant derived from NCI-H929 multiple myeloma cells (BCMA-secreting cell line, the supernatant containing soluble BCMA). Neither tumor-cell lysis nor cytokine production was observed to be affected by any of the concentrations of NCI-H929-derived soluble BCMA (up to 1000 ng/mL). Both tumor-cell lysis and cytokine production were only minimally decreased at similarly high physiological levels of recombinant BCMA.

Proliferation in response to BCMA was measured in BCMA-55-LS-O/SSE CAR-expressing T cells and mock-processed T cells. Transduced T cells were labeled with cell trace violet (CTV) and cultured in the presence of BCMA-positive target cells, BCMA-negative target cells, or no cells, at an effector to target (E:T) ratio of 1:1, for 72 hours. Proliferation was measured by flow cytometry. Proliferation of T cells (CD4+ and CD8+ T cells) was observed only for BCMA-55-LS-O/SSE CAR-expressing T cells in response to incubation with BCMA-positive target cells.

D. Transduced T cells Harvested from Healthy Donors and a Myeloma Patient

T cells engineered to express BCMA-55-LS-O/SSE CAR harvested from multiple myeloma patients were compared to those derived from healthy human donors following a 24-hour incubation with BCMA+ and BCMA-K562 target cells. T cells not expressing a CAR were also evaluated as a negative control. CAR T cells derived from multiple myeloma patients demonstrated similar expression, expansion and antigen-specific activities as compared to cells expressing the CAR derived from healthy human donors.

Example 8: Anti-BCMA CARs with Different Spacers

Polynucleotide constructs encoding anti-BCMA CARs were generated that contained different spacer regions between the scFv and transmembrane segments of the encoded CAR polypeptide. Specifically, CARs were generated containing: (1) a spacer derived from an IgG hinge region (e.g., e.g., BCMA-5-SS, BCMA-9-SS, BCMA-18-SS, BCMA-23-SS, BCMA-25-SS, BCMA-26-SS, BCMA-52-SS, BCMA-55-SS, and Reference1 (VH/VL)-SS); or (2) a short spacer derived from the ectodomain of CD28 (e.g. BCMA-52-SCD28 and BCMA-55-SCD28). T cells expressing such spacer-containing CARs were compared to T cells transduced with polynucleotide constructs encoding exemplary CARs containing spacers as described in Example 3 (e.g. BCMA-1-LS, BCMA-5-LS, BCMA-9-LS, BCMA-18-LS, BCMA-23-LS, BCMA-25-LS, BCMA-26-LS, BCMA-27-LS, BCMA-52-LS, BCMA-55-LS, and Reference1 (VH/VL)-LS).

Figure 8:
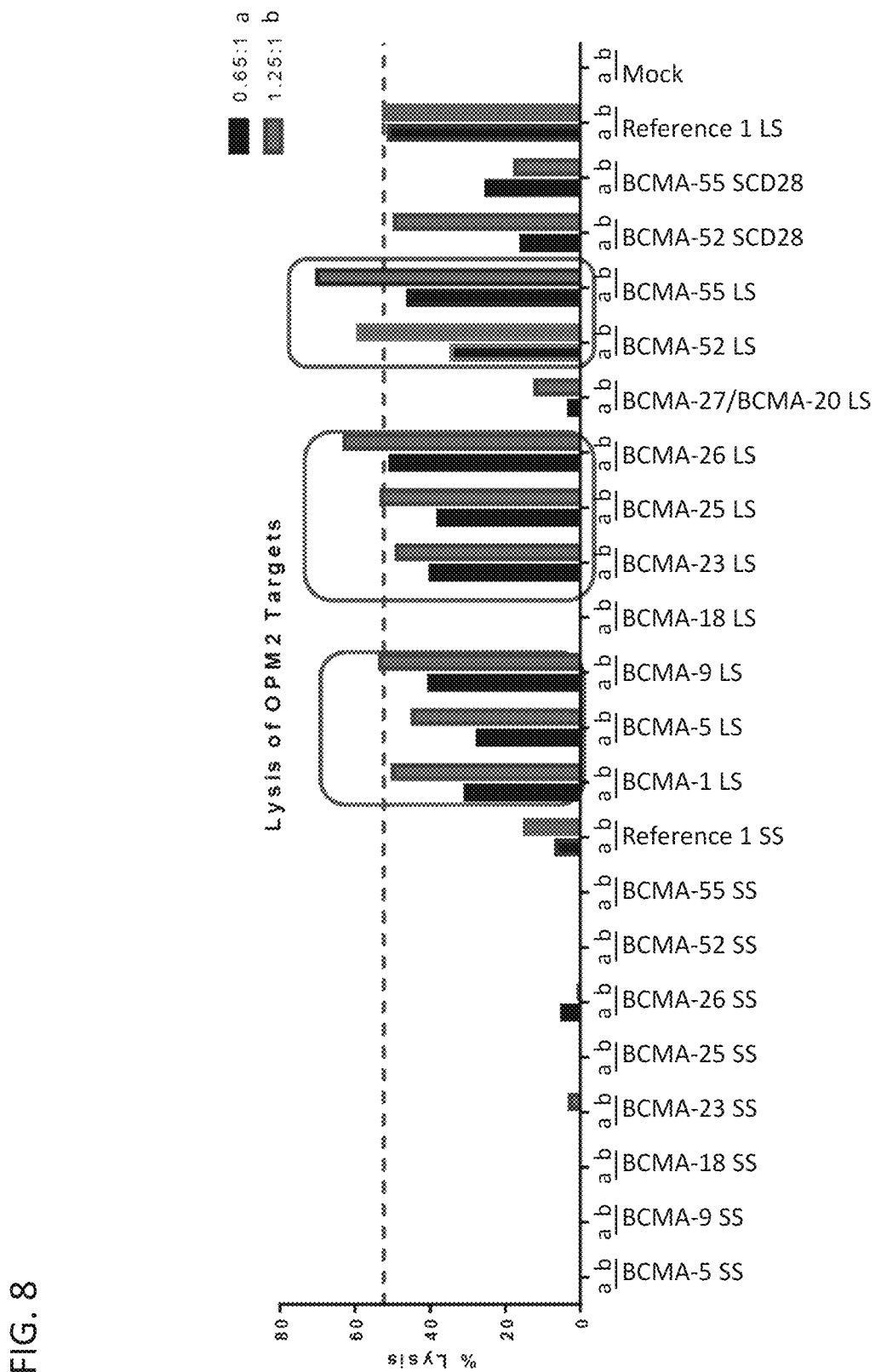
FIG. 8 depicts results of an assay assessing cytolytic activity of anti-BCMA-expressing CAR T cells that express CARs containing different spacer regions, on OPM2 target cells.

CAR-expressing cells were assessed for cytolytic activity by monitoring the lysis of OPM2 human multiple myeloma target cells cultured with CAR-expressing T cells at an effector to target (E:T) ratio of 1.25:1 and 0.65:1. Cells that did not express a CAR (mock) were used as a negative control. Cytolytic activity was assessed as described in Example 7. For most assessed CAR-expressing cells, target cell lysis was greater for cells engineered to express a CAR containing a $C_H2$-$C_H3$-hinge spacer as compared to cells engineered with a CAR containing a shorter spacer (FIG. 8).

Example 9: Assessment of Agents on Blocking Activity of Anti-BCMA CAR Activity

The function of anti-BCMA CAR-expressing cells was assessed following incubation with BCMA-expressing target cells and soluble BCMA or other proteins. Cytolytic activity and cytokine production was assessed substantially as described in Example 7.

A. Cytolytic Activity

1. Soluble Recombinant BCMA (rBCMA)—OPM2 Target Cells

Figure 9A:
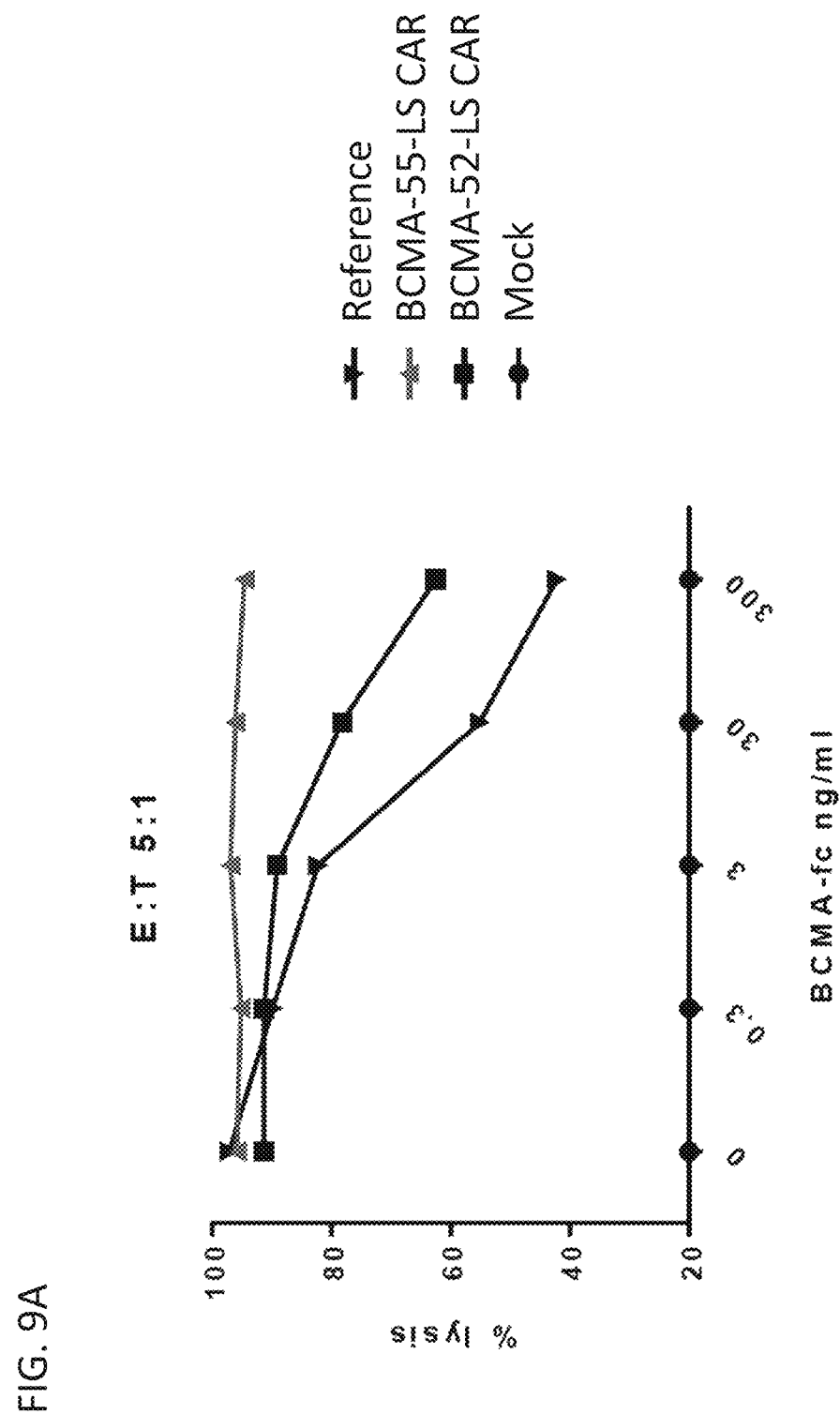
FIGS. 9A and 9B depict results of an assay assessing cytolytic activity of anti-BCMA CAR-expressing T cells following incubation of anti-BCMA CAR-expressing T cells with OPM2 target cells in the presence of soluble BCMA-Fc.

Anti-BCMA CAR-expressing T cells, BCMA-52-LS CAR, BCMA-55-LS CAR or Reference binding domain-containing CAR, were incubated with OPM2 target cells at an E:T ratio of 5:1 in the presence of soluble BCMA-Fc at 0, 0.3, 3, 30 or 300 ng/mL. As shown in FIG. 9A cytolytic activity of T cells expressing the Reference binding domain-containing CAR or BCMA-52-LS CAR were substantially reduced in the presence of 3 ng/mL or more BCMA-Fc, however the cytolytic activity of cells expressing BCMA-55-LS CAR was not blocked by the presence of up to 300 ng/mL BCMA-Fc.

Figure 9B:
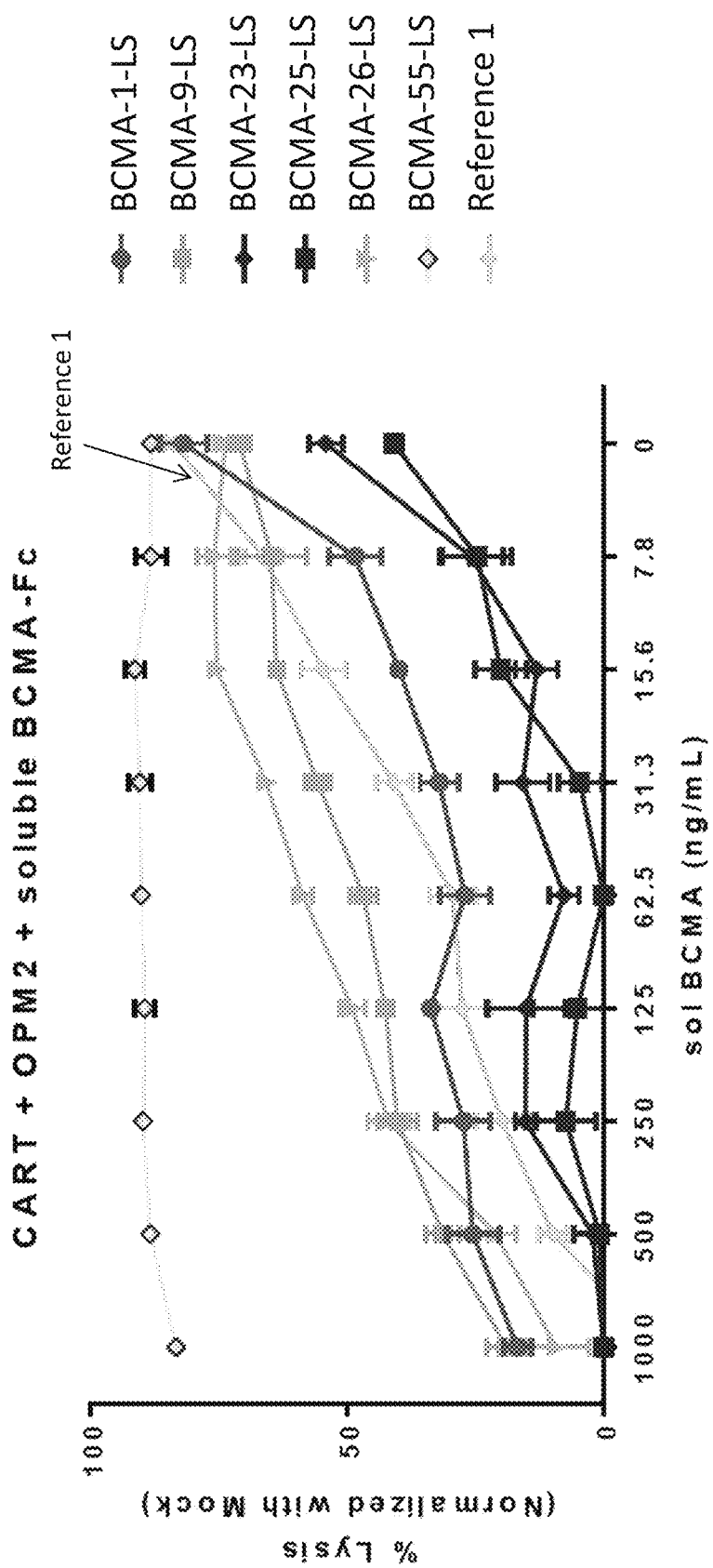

In another experiment, Anti-BCMA CAR-expressing T cells (BCMA-1-LS CAR, BCMA-9-LS CAR, BCMA-23-LS CAR, BCMA-25-LS CAR, BCMA-26-LS CAR, BCMA-55-LS CAR and Reference1 (VH/VL)-LS CAR) were incubated with OPM2 target cells at an E:T ratio of 5:1 in the presence of soluble BCMA-Fc at concentrations of 0, 7.8, 15.6, 31.3, 62.5, 125, 250, 500 and 1000 ng/mL. As shown in FIG. 9B the cytolytic activity of cells expressing BCMA-55-CAR was not blocked by the presence of BCMA-Fc at any of the concentrations tested; however, the presence of variable concentrations of BCMA-Fc blocked activity of cells expressing other anti-BCMA CARs to different extents.

2. Multiple Myeloma Cell Line (H929) Supernatant—OPM2 Target Cells

Figure 10A:
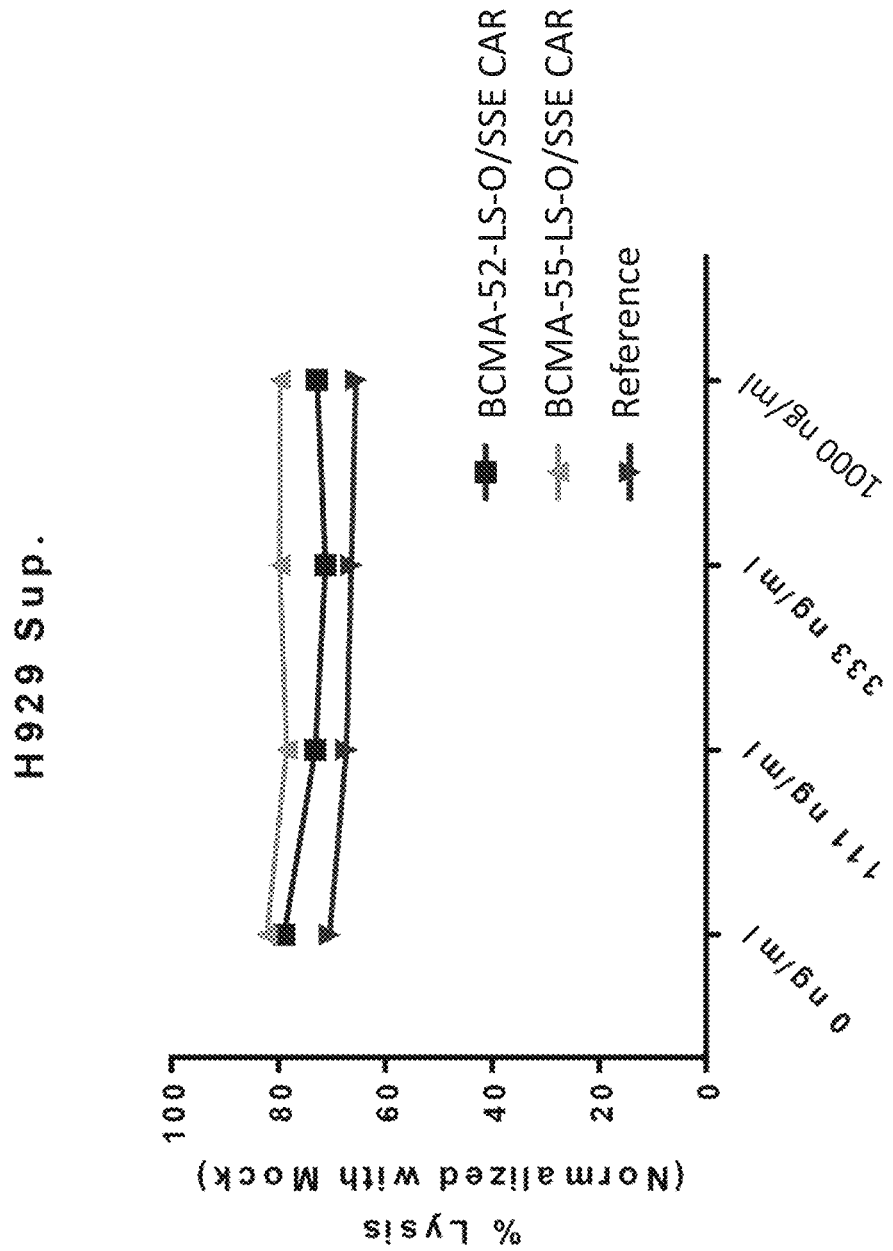
FIG. 10A depicts results of an assay assessing cytolytic activity of optimized (O/SSE) anti-BCMA CAR-expressing T cells in the presence of supernatant from the H929 multiple myeloma cell line.

Optimized, splice site eliminated (O/SSE) anti-BCMA CAR-expressing T cells, BCMA-52-LS-O/SSE CAR, BCMA-55-LS-O/SSE CAR or Reference binding domain-containing CAR, were incubated with OPM2 target cells at an E:T ratio of 5:1 in the presence of 0, 111, 333 and 1000 ng/mL culture supernatant from the H929 multiple myeloma cell line. The concentration of soluble BCMA was quantified from the H929 supernatant by ELISA. As shown in FIG. 10A the cytolytic activity of cells expressing BCMA-52-LS-O/SSE CAR, BCMA-55-LS-O/SSE CAR or Reference CAR were not blocked by the presence of H929 supernatant.

3. Soluble Recombinant BCMA (rBCMA) and H929 Supernatant—RPMI-8226 Target Cells

In a further study, optimized, splice site eliminated (O/SSE) BCMA-55-LS-O/SSE CAR-expressing T cells, were incubated with RPMI-8226 tumor target cells at an E:T ratio of 3:1 in the presence of 0, 111, 333 and 1000 ng/mL soluble BCMA from culture supernatant from the H929 multiple myeloma cell line (soluble BCMA quantitated by ELISA) or BCMA-Fc. The cytolytic activity of cells expressing BCMA-52-LS-O/SSE CAR, BCMA-55-LS-O/SSE CAR or Reference CAR was not blocked by the presence of H929 supernatant.

4. B-Cell Activating Factor (BAFF)

Figure 10B:
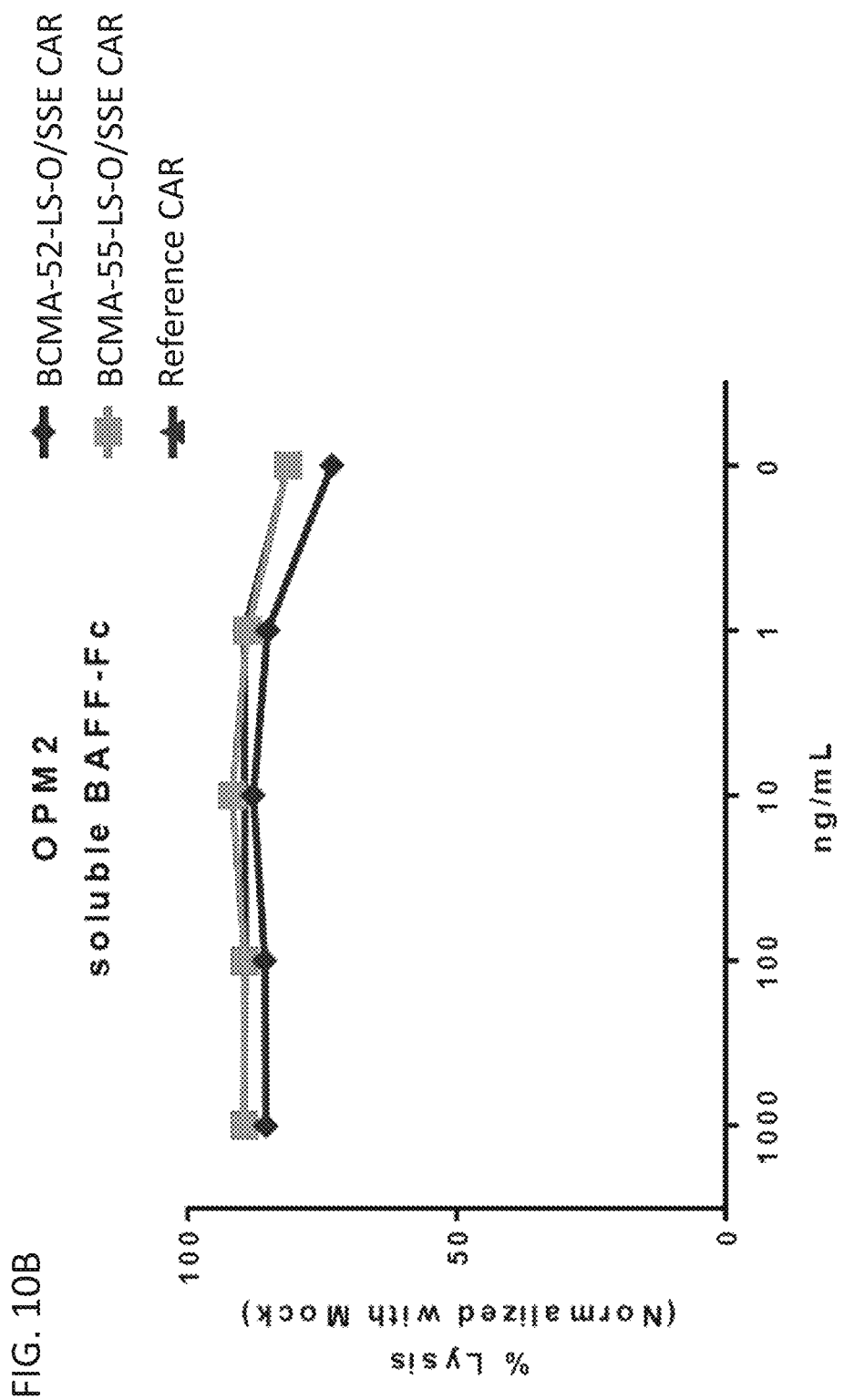
FIG. 10B depicts results of an assay assessing cytolytic activity of optimize (O/SSE) anti-BCMA CAR-expressing T cells in the presence of recombinant B-cell activating factor (BAFF).

Optimized, splice site eliminated (O/SSE) anti-BCMA CAR-expressing T cells, BCMA-52-LS-O/SSE CAR, BCMA-55-LS-O/SSE CAR or Reference CAR, were incubated with OPM2 target cells at an E:T ratio of 5:1 in the presence of 0, 1, 10, 100 and 1000 ng/mL recombinant B-cell activating factor (BAFF), a ligand for BCMA. As shown in FIG. 10B, cytolytic activity of T cells expressing BCMA-52-LS-O/SSE CAR, BCMA-55-LS-O/SSE CAR or Reference CAR were not blocked by the presence of BAFF.

B. Cytokine Release

1. BCMA-Fc

Figure 11A:
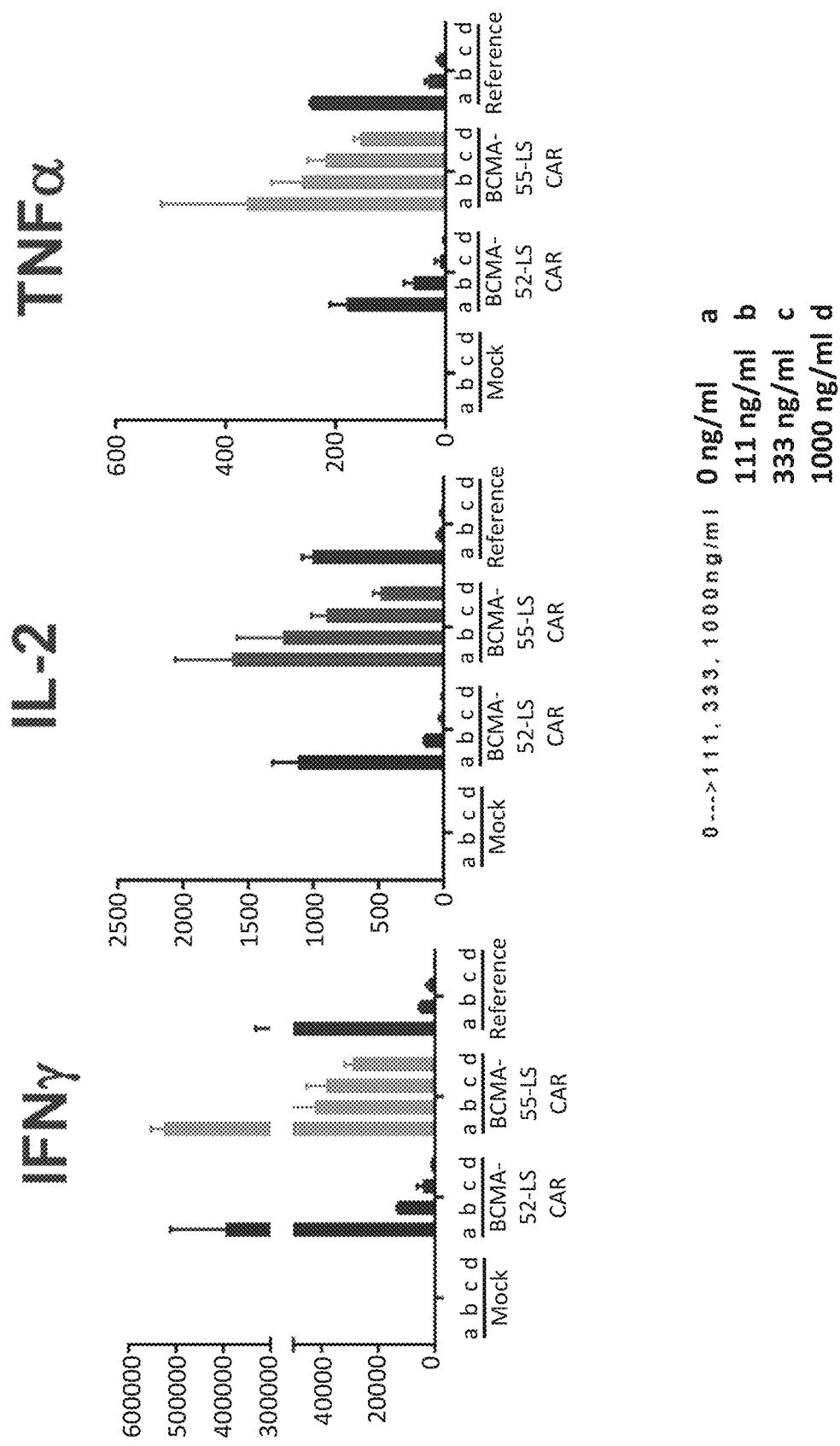
FIGS. 11A and 11B depict results of an assay assessing IFNγ, IL-2, and TNFα cytokine release following incubation of anti-BCMA CAR-expressing T cells with OPM2 target cells in the presence of soluble BCMA-Fc (FIG. 11A) or supernatant from a multiple myeloma cell line H929 (FIG. 11B) at different concentrations (0 ng/mL, 111 ng/mL, 333 ng/mL and 1000 ng/mL indicated as a, b, c and d, respectively, in the figures).

Anti-BCMA CAR-expressing T cells, BCMA-52-LS CAR, BCMA-55-LS CAR or Reference-LS CAR, were incubated with OPM2 target cells at an E:T ratio of 5:1 in the presence of soluble BCMA-Fc at 0, 111, 333 and 1000 ng/mL T cells not expressing a CAR (mock) also were assessed. Cytokine accumulation of IFN-γ, TNF-α and IL-2 in supernatant was assessed. As shown in FIG. 11A, cytokine accumulation in cultures containing T cells expressing the Reference CAR or BCMA-52-CAR were substantially reduced in the presence of 111 ng/mL or more BCMA-Fc, however less reduction in cytokine accumulation was observed in cultures containing T cells expressing BCMA-55-CAR in the presence of soluble BCMA-Fc at all concentrations tested.

2. Multiple Myeloma Cell Line (H929) Supernatant

Figure 11B:
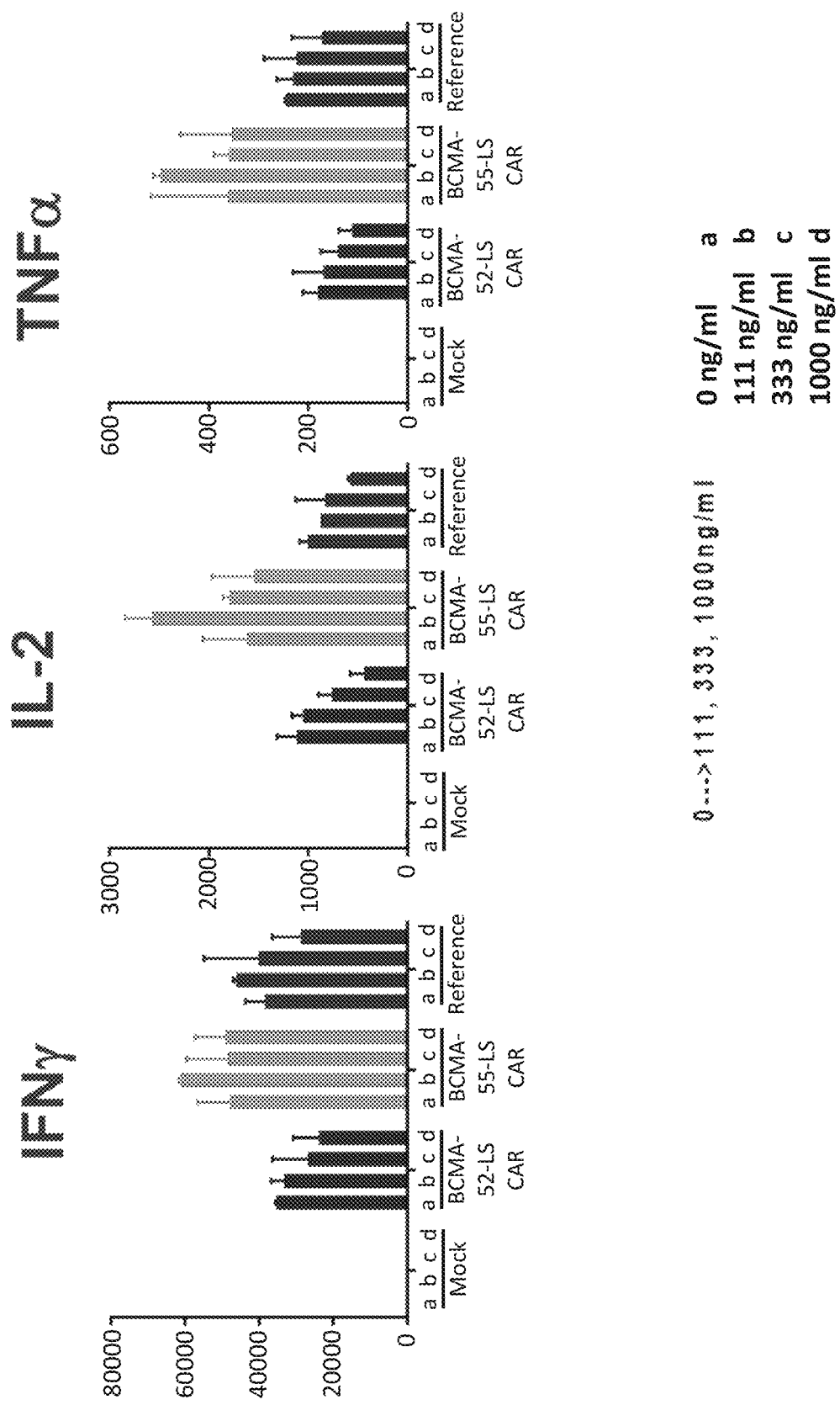

Anti-BCMA CAR-expressing T cells, BCMA-52-LS CAR, BCMA-55-LS CAR or Reference-LS CAR, were incubated with OPM2 target cells at an E:T ratio of 5:1 in the presence of 0, 111, 333 and 1000 ng/mL culture supernatant from a multiple myeloma cell line H929. Cytokine accumulation in cultures containing T cells expressing BCMA-52-CAR, BCMA-55-CAR or Reference CAR were not blocked by the presence of H929 supernatant (FIG. 11B)

Example 10: Anti-Tumor Effect of Anti-BCMA CAR-Expressing T Cells after Adoptive Transfer In Vivo in an Animal Model The anti-tumor effects of exemplary engineered anti-BCMA CAR-expressing primary human T cells were assessed by monitoring tumors following adoptive transfer of cells in tumor-bearing animal models, including OPM2 human multiple myeloma xenograft mouse model (orthotopic bone marrow model) and RPMI 8226 human multiple myeloma xenograft mouse model (subcutaneous implant model).

A. OPM2 (Orthotopic/Bone Marrow) Model

NOD.Cg.Prkdc$^{scid}$IL2rg$^{tm1Wj1}$/SzJ (NSG) mice were injected intravenously (i.v.) with $2 \times 10^6$ OPM2 (multiple myeloma) cells transfected with firefly luciferase (OPM2-ffluc). On day 14, following tumor engraftment, mice received a single intravenous (i.v.) injection of anti-BCMA CAR T cells expressing optimized, splice site eliminated (O/SSE) BCMA-23-LS-O/SSE CAR, BCMA-26-LS-O/SSE CAR or BCMA-55-LS-O/SSE CAR. The anti-BCMA CAR-expressing T cells were administered at a dose of either $1 \times 10^6$ (low dose, n=8) or $3 \times 10^6$ (high dose, n=8) CAR-expressing T cells per mouse, and each condition repeated for CAR-expressing T cells derived from two different donors. As a control, mice were administered cells not expressing a CAR (mock, n=8) or were untreated (n=3). Survival and tumor burden were assessed over 90 days.

Anti-tumor activity of the adoptively transferred CAR-expressing (CAR-T) cells was monitored by bioluminescence imaging every 3 to 6 days post CAR-T cell administration for the length of the study. For bioluminescence imaging, mice received intraperitoneal (i.p.) injections of luciferin substrate (CaliperLife Sciences, Hopkinton, Mass.) resuspended in PBS (15 µg/g body weight). Mice were anesthetized and imaged essentially as described in WO2015/095895. The total flux (photon/s) was determined at each time point. For the negative control treated mice, animals were sacrificed between 19 and 23 days after CAR-T cell administration, due to high tumor burden. Representative results from one donor-derived CAR-expressing T cells are shown in FIG. 12A.

Figure 12A:
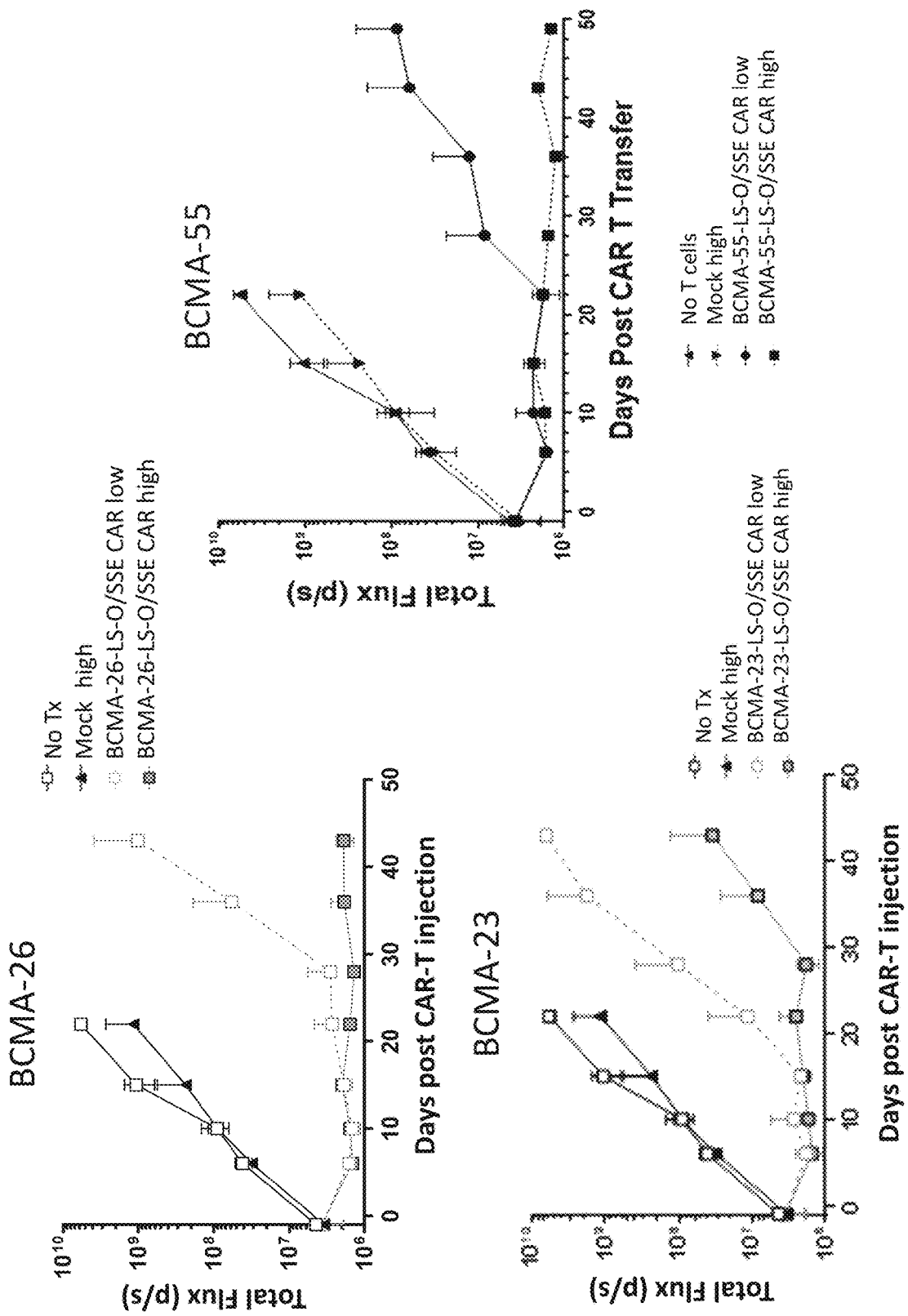
FIG. 12A depicts results of an assay assessing tumor growth in an OPM2 human multiple myeloma xenograft mouse model, following a single intravenous injection of CAR T cells expressing optimized (O/SSE) anti-BCMA CARs.

As shown in FIG. 12A, for all treated mice, the tumor in mice receiving mock-processed T cells or no T cells continued to grow over the course of the study. Compared to the control mice, mice that received an adoptive transfer of T cells engineered to express BCMA-23-LS-O/SSE CAR, BCMA-26-LS-O/SSE CAR, or BCMA-55-LS-O/SSE CAR, were observed to generally have a lower degree of bioluminescence signal, indicating a reduction in tumor growth over time and/or a lower degree of tumor growth in the treated animals. The effect on tumor growth was greater with the higher dose of anti-BCMA CAR expressing cells for the exemplary tested anti-BCMA CARs.

Figure 12B:
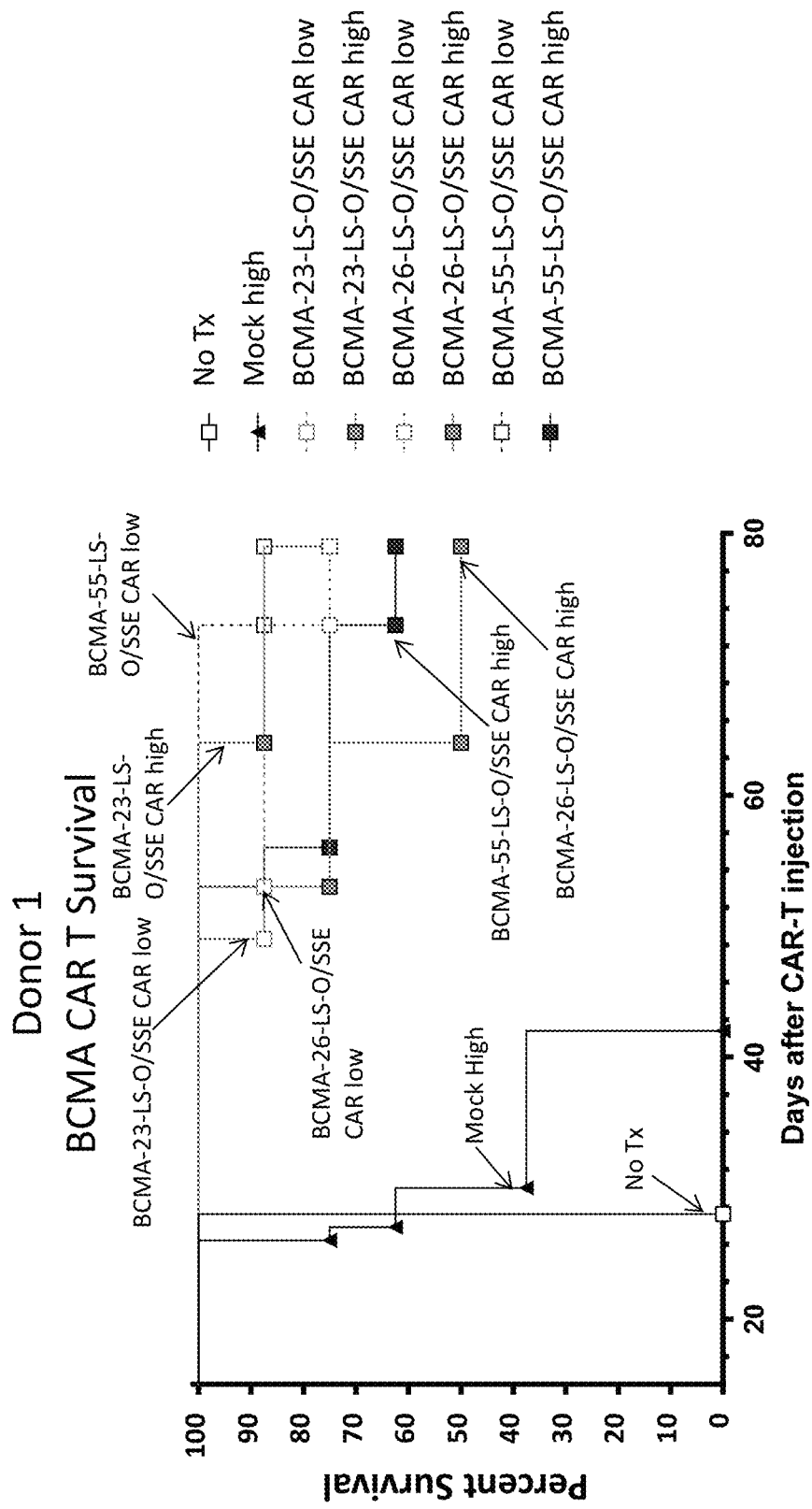
FIG. 12B depicts results of an assay assessing survival in an OPM2 human multiple myeloma xenograft mouse model, following a single intravenous injection of CART cells expressing optimized (O/SSE) anti-BCMA CARs.

Survival of mice treated as described above were assessed and compared until day 79 post-infusion of CAR-expressing T cells. Representative survival curves, Kaplan-Meier method (GraphPad Prism 7.0, GraphPad Software, La Jolla), from one donor are shown in FIG. 12B. As shown, the tested anti-BCMA CAR-T cells at the low and high dose resulted in greater percent survival of mice compared to mice receiving no treatment or mock-processed T cells. Mice also were assessed for presentation of clinical signs associated with tumor burden, including hind limb paralysis (HLP), greater than 20% body weight loss (>20% BWL), and graft-versus-host disease (GvHD). The number of mice with these clinical signs was reduced compared to mice receiving no treatment or mock T cells.

B. RPMI-8226 (Subcutaneous) Model

NOD.Cg.PrkdcscidIL2rgtm1Wj1/SzJ (NSG) mice were injected subcutaneously with RPMI 8226 (peripheral blood plasmacytoma) cells. On Day 27, the mice were randomized into groups based on a minimum mean tumor volume of approximately 130 mm$^3$. On Day 29, mice received a single intravenous (i.v.) injection of primary human T cells (CD4+ and CD8+) engineered to express optimized, splice site eliminated (O/SSE) BCMA-23-LS-O/SSE CAR, BCMA-26-LS-O/SSE CAR, or BCMA-55-LS-O/SSE CAR at a dose of $1 \times 10^6$ (low dose, n=8) or $3 \times 10^6$ (high dose, n=8) CAR-expressing T cells. Each condition was repeated for CAR-expressing T cells derived from two different donors. Mice that were administered cells that were mock-processed and untreated mice were used as negative controls. Tumor volume was measured by calipers twice weekly up to Day 152 post CAR T-cell transfer and euthanized when moribund, 20% weight loss, or when tumor volume exceeded 1500 mm³. Survival curves were plotted up to Day 108 post CAR T-cell transfer using the Kaplan-Meier method (GraphPad Prism 7.0, GraphPad)

Figure 13A:
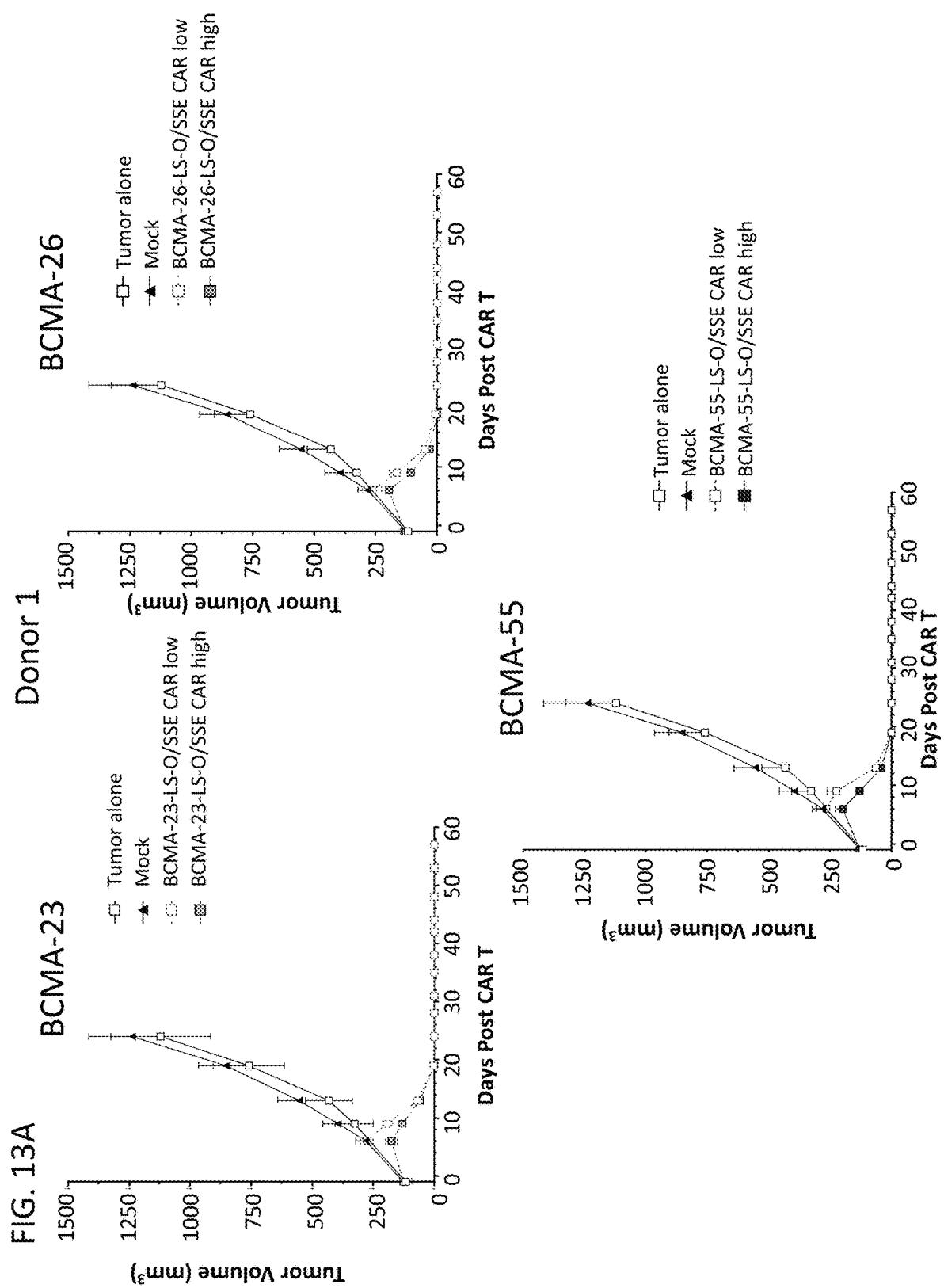
FIG. 13A depicts results of an assay assessing tumor growth in an RPMI-8226 (subcutaneous) xenograft mouse model, following a single intravenous injection of CART cells expressing optimized (O/SSE) anti-BCMA CARs.
Figure 13B:
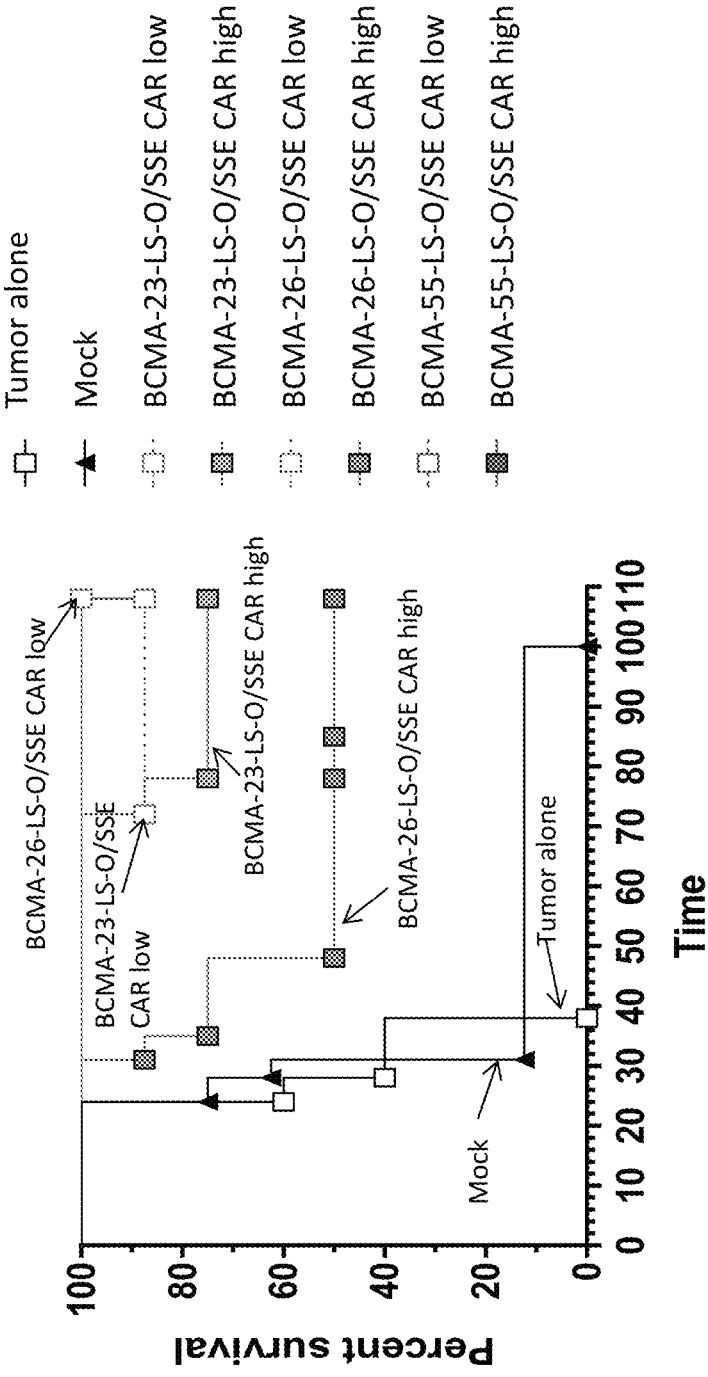
FIG. 13B depicts survival in an RPMI-8226 (subcutaneous) xenograft mouse model, following a single intravenous injection of CART cells expressing optimized (O/SSE) anti-BCMA CARs.

Representative results for tumor growth and survival from CAR-expressing T cells derived from one donor are shown in FIGS. 13A and 13B, respectively. As shown in FIG. 13A, the tumor continued to grow over the course of the study following adoptive transfer of negative control cells or in mice not receiving treatment. Compared to the control mice, mice that received an adoptive transfer of T cells engineered to express BCMA-23-LS-O/SSE CAR, BCMA-26-LS-O/SSE CAR, or BCMA-55-LS-O/SSE CAR showed substantially reduced tumor volume after receiving the low or high dose of CAR-expressing T cells (FIG. 13A). In this model, mice administered both tested doses of anti-BCMA CAR T cells exhibited complete regression of tumor growth by 20 days post CAR T-cell transfer, which continued throughout the duration of the study assessment shown in FIG. 13A.

The percent survival of mice administered anti-BCMA CAR-expressing T cells also was substantially greater than control groups (FIG. 13B). At 108 days post-CAR T cell infusion, two animals had been lost post-tumor elimination in the group treated with the high dose of BCMA-26-LS-O/SSE CAR-expressing T cells, although this was likely due to graft versus host disease (GVHD) symptoms in this model. All other CAR-T cell treated mice remained alive up to 108 days post-CAR T cell administration.

The presence of CAR+ T cells in the blood was monitored to assess pharmacokinetics of CAR-expressing T cells in the mice from treated. The 8 mice of each treatment group were divided into 2 groups of 4 mice. Blood was drawn weekly, by retro-orbital bleeding, alternating between the 2 groups such that each mouse was bled every other week for 4 weeks post CAR-T cell administration (i.e., on days 7, 14, 21 and 28 post CAR-T cell administration). The collected blood was analyzed for the number of CAR-expressing T cells, as determined using an antibody against the surrogate marker or soluble BCMA-Fc, and non-CAR T cells, per µL blood by flow cytometry (FlowJo software, Treestar Inc., Ashland, Oreg.).

Figure 14A:
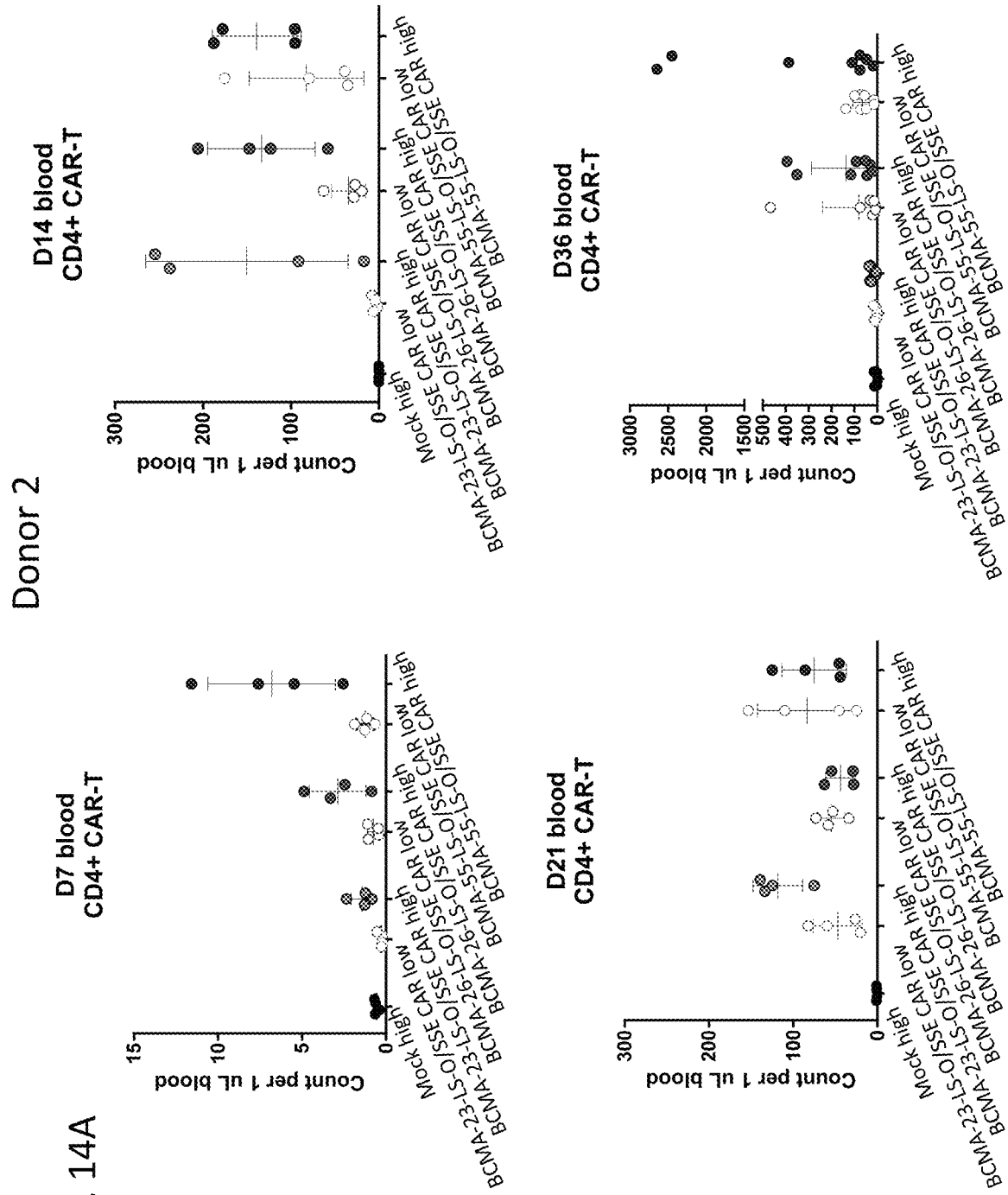
FIGS. 14A and 14B depict results of an assay assessing the number of CD4+(FIG. 14A) and CD8+(FIG. 14B) CAR-positive T cells in the blood from RPMI-8226 (subcutaneous) xenograft mice treated with optimized (O/SSE) anti-BCMA CAR T cells derived from a single donor (Donor 2).
Figure 14B:
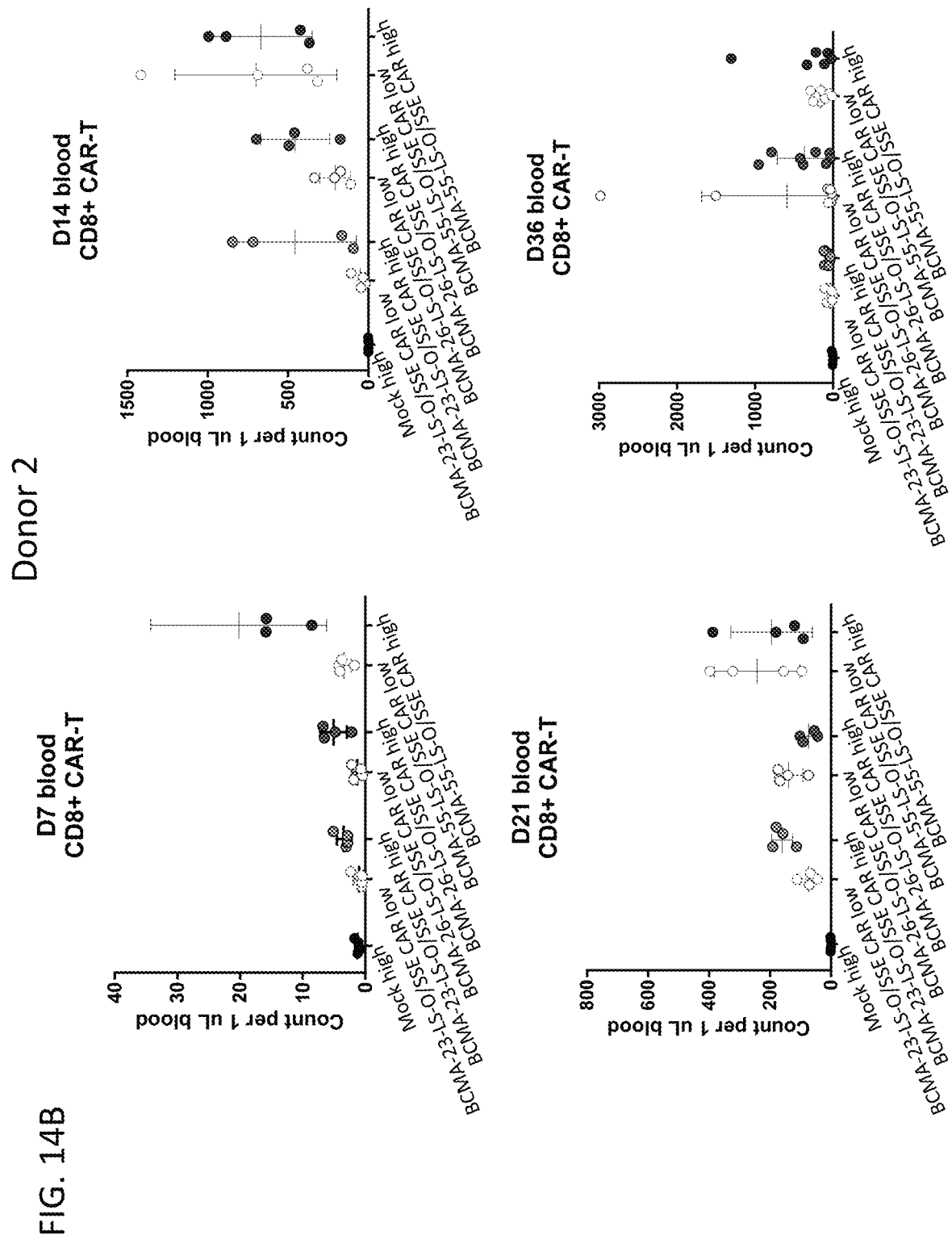
Figure 15A:
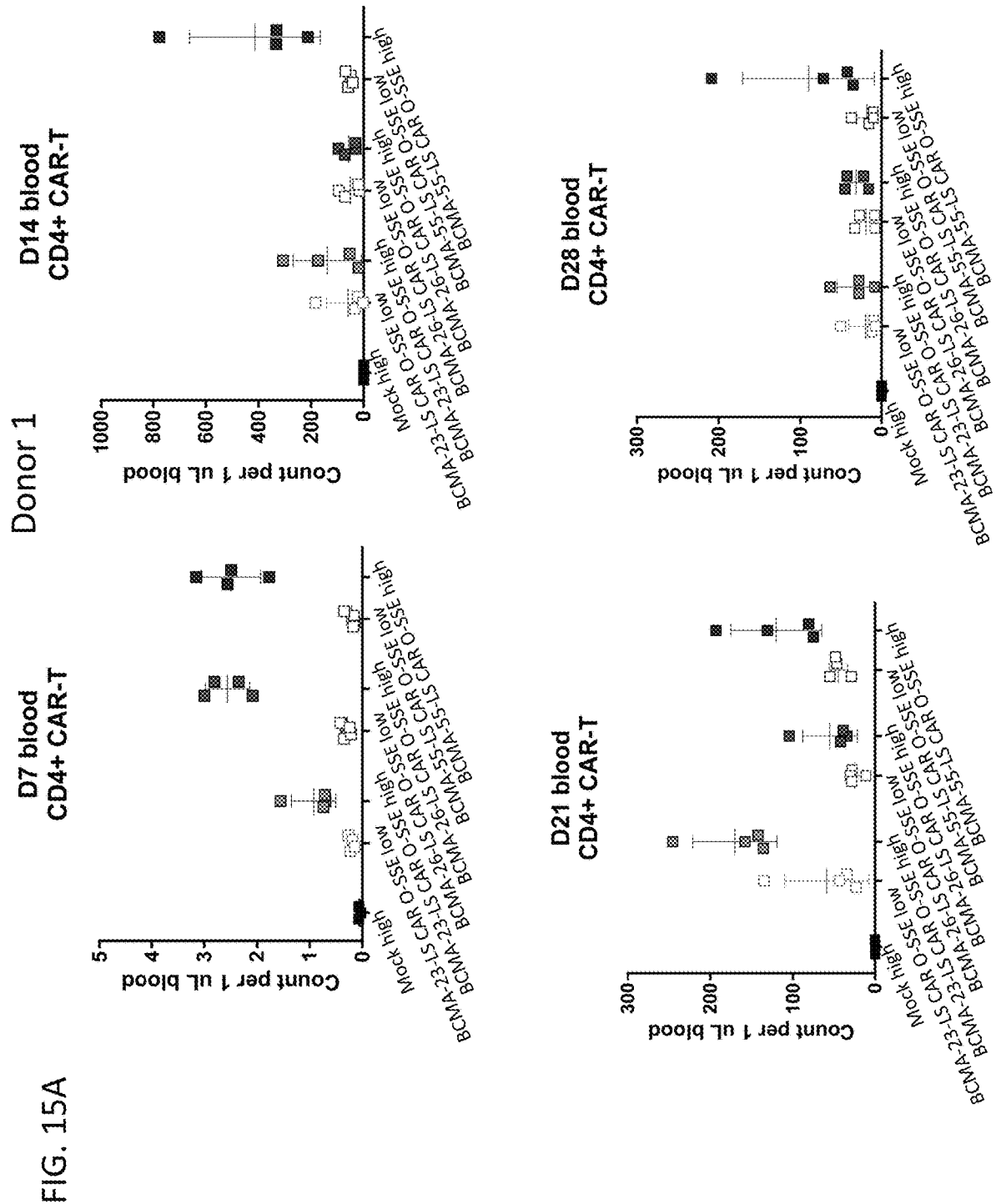
FIGS. 15A and 15B depict results of an assay assessing the number of CD4+(FIG. 15A) and CD8+(FIG. 15B) CAR-positive T cells in the blood from RPMI-8226 (subcutaneous) xenograft mice treated with optimized (O/SSE) anti-BCMA CAR T cells derived from a single donor (Donor 1).
Figure 15B:
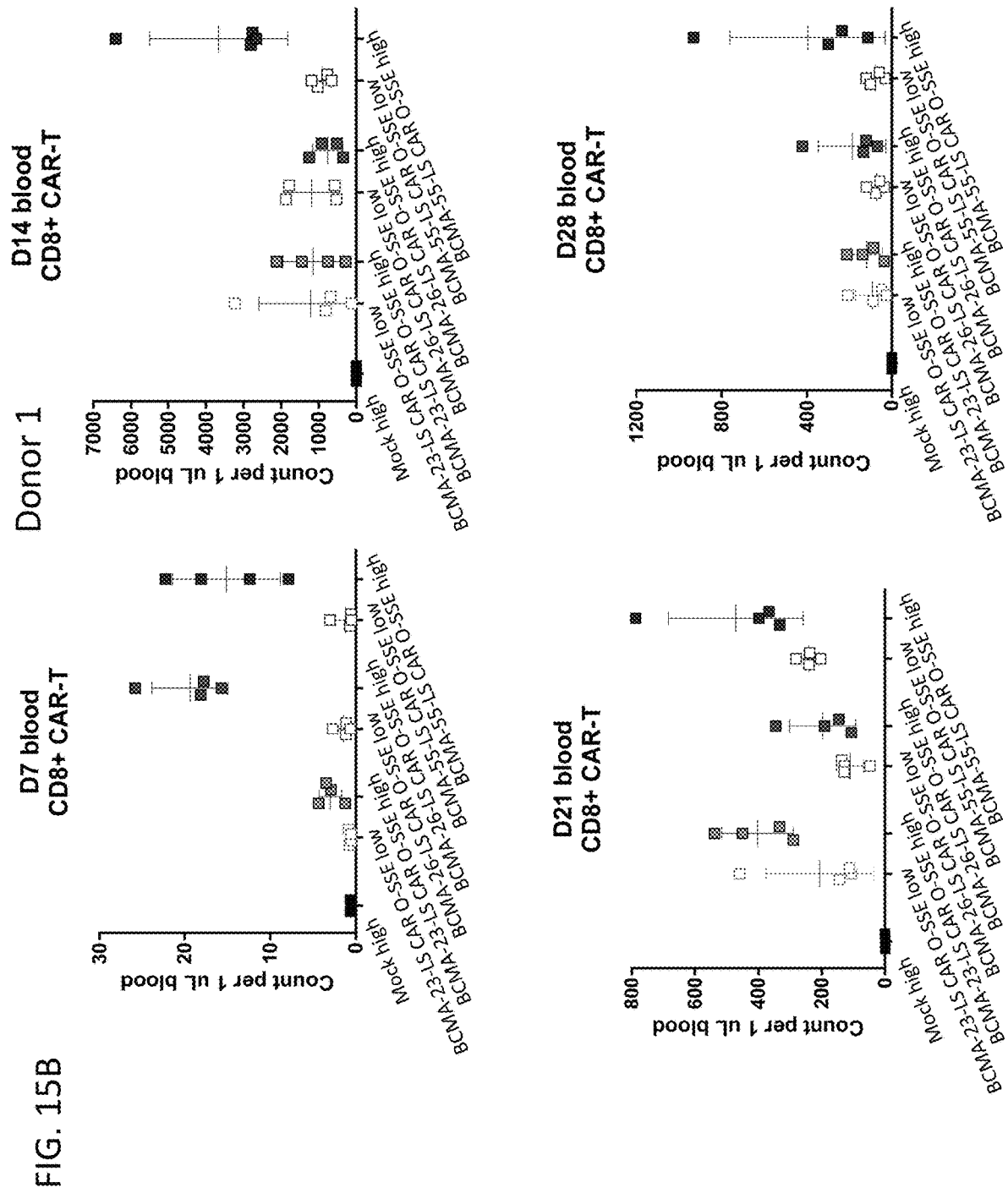

The number of CD4+ and CD8+ T cells per µL of blood at days 7, 14, 21 and 28 are shown in FIG. 14A and FIG. 14B, respectively, for one donor and in FIG. 15A and FIG. 15B, respectively, for the second donor. As shown, CAR-T expansion occurred in high and low dose groups in CD4+ and CD8+ T cells, with maximum or peak expansion observed at day 14 post CAR T-cell transfer for both donors. At all assessed times post CAR-T cell transfer, greater numbers of CD8+ CAR+ T cells were observed compared to CD4+ CAR+ T cells for both donors (compare FIG. 14A and FIG. 14B or FIG. 15A and FIG. 15B). T cells engineered to express BCMA-55-LS-O/SSE CAR exhibited greater CAR expression compared to T cells expressing BCMA-23-LS-O/SSE CAR and BCMA-26-LS-O/SSE CAR constructs, which exhibited comparable expression to each other. These results demonstrate BCMA-55-LS CAR expressing T cells can be identified circulating in the blood during tumor clearance.

Example 11: Assessment of Signals Through Anti-BCMA Chimeric Antigen Receptor (CAR) in a Nur77-tdTomato Reporter Signal in Reporter Cell Line An exemplary stable Jurkat T cell reporter cell line was generated containing a Nur77 knock-in reporter, where the nucleic acid sequences encoding the reporter molecule was knocked-in at the endogenous Nur77 locus via homology dependent repair (HDR). Orphan nuclear hormone receptor Nur77 (also called Nr4a1) is an immediate-early response gene induced by activation of signal from the T cell receptor and/or via molecules containing immunoreceptor tyrosine-based activation motif (ITAM). The Nur77-reporter cell line was used to assess T cell activation in CAR-engineered cells as Nur77 is an immediate early gene product in T lymphocytes; transcription is initiated specifically downstream of CD3 zeta signaling, and is not influenced by cytokine or TLR mediated signals. In a Jurkat T cell clone E6-1 (ATCC® TIB-152™), nucleic acid sequence encoding a red fluorescent protein (RFP; such as the tdTomato fluorescent protein) was targeted for integration in-frame with the endogenous Nr4a1 (Nur77) gene at the final exon, prior to the stop codon, and after a "self-cleaving" T2A element (sequence set forth in SEQ ID NO:686 or 687, encoding polypeptide sequence set forth in SEQ ID NO: 631, 653 or 654), to allow for coexpression of RFP as a reporter of Nur77 expression, by introducing a genetic disruption using gene editing and targeting a transgene for integration at a site near the genetic disruption by homology-dependent repair (HDR). The Nur77-tdTomato reporter cell line was engineered to express various anti-BCMA chimeric antigen receptors, and reporter expression was assessed.

Viral vectors containing polynucleotides encoding the following anti-BCMA chimeric antigen receptors (CARs), described in Example 3, were introduced into the Nur77-tdTomato reporter Jurkat T cell line: BCMA-55-LS-O/SSE CAR, BCMA-26-LS-O/SSE CAR, BCMA-23-LS-O/SSE CAR, and BCMA-25-LS-O/SSE CAR. Anti-BCMA CAR-expressing reporter cells were evaluated for activity of Nur77 signaling in response to increasing amounts of plate-bound recombinant BCMA or in response to exemplary multiple myeloma cell lines after 20 hours of co-culture.

A. Nur77 Signaling in Response to Plate-Bound Recombinant BCMA

Reporter cells transduced with a viral vector encoding BCMA-55-LS-O/SSE CAR were incubated for 6 hours in 96-well cell culture plates that had been coated overnight with varying concentrations (0.008 µg/mL, 0.04 µg/mL, 0.2 µg/mL, 1 µg/mL and 5 µg/mL) of BCMA-Fc (soluble human BCMA fused at its C-terminus to an Fc region of IgG) fusion polypeptide. A recombinant Fc polypeptide was used as a control (Fc Control). As shown in FIG. 16A, a dose-dependent increase in tdTomato expression was observed following stimulation of anti-BCMA CAR-expressing reporter cells with recombinant antigen.

Figure 16B:
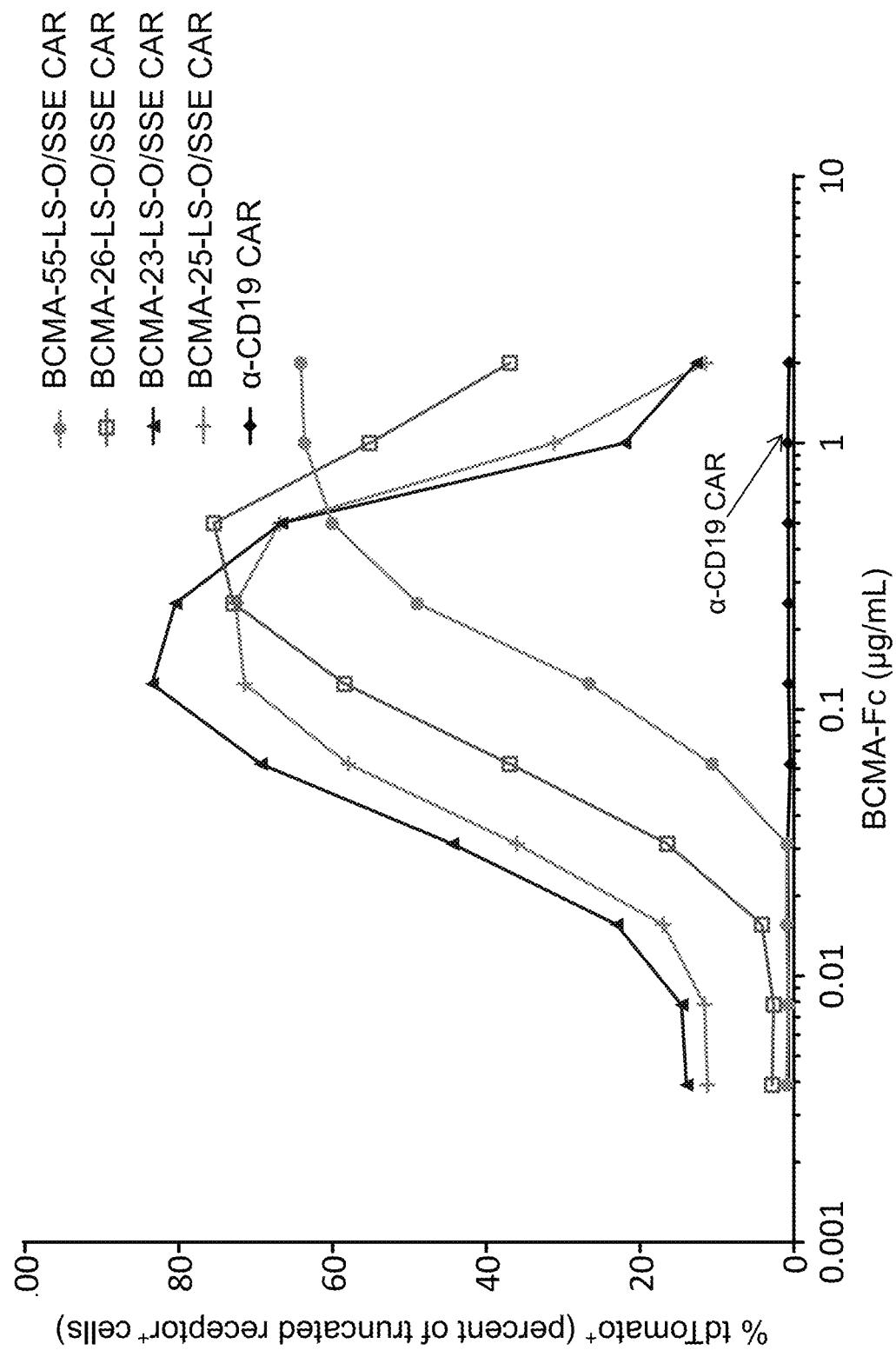
FIG. 16B depicts results of an assay assessing percentage of tdTomato+ cells among cells expressing the truncated receptor, in reporter cells expressing BCMA-55-LS-O/SSE CAR, BCMA-26-LS-O/SSE CAR, BCMA-23-LS-O/SSE CAR, and BCMA-25-LS-O/SSE CAR, incubated with ten (10) 2-fold serial dilution of BCMA-Fc. Cells expressing a CAR specific for a different antigen (anti-CD19 CAR) was used as control.

In another study, reporter cells engineered to express BCMA-55-LS-O/SSE CAR, BCMA-26-LS-O/SSE CAR, BCMA-23-LS-O/SSE CAR, and BCMA-25-LS-O/SSE CAR were incubated with ten (10) 2-fold serial dilutions of BCMA-Fc. Reporter cells expressing an anti-CD19 CAR was used as a non-target control. The percentage of tdTomato-expressing cells within the population of cells expressing the CAR (as determined based on expression of the surrogate marker) was determined. As shown in FIG. 16B, a dose-dependent increase in tdTomato expression was observed following stimulation of with recombinant antigen.

No response to stimulation with BCMA-Fc was observed by the control reporter cells expressing a CAR against a non-target antigen.

B. Nur77 Signaling in Response to Multiple Myeloma Cell Lines

Reporter cells transduced with a viral vector encoding BCMA-55-LS-O/SSE CAR were incubated for 20 hours with NALM6, Daudi, RPMI-8226, MM1S, OPM2, and H929 cells. Different levels of RFP expression were observed depending on the cell line which conferred stimulation of the anti-BCMA CAR-expressing reporter cells.

To assess the amounts of BCMA expression on the surface of the multiple myeloma cell lines used to stimulate the anti-BCMA CAR-expressing reporter cells, the cells were stained with anti-human BCMA antibody (BioLegend, San Diego, Calif.), flow cytometry events were collected on an LSRFortessa™ flow cytometer (BD Biosciences, San Jose, Calif.) and data were analyzed with FlowJo software (Treestar Inc., Ashland, Oreg.). BCMA antigen density (AD) was determined by using Quantum™ Simply Cellular® anti-Mouse IgG microsphere beads coated with the same anti-human BCMA antibody. Microspheres were labeled and BCMA antibody binding capacity was calculated. The results confirmed the detection of a parameter (detectable levels of the reporter) indicative of specific CAR activity in CAR-expressing reporter cells, when incubated with each of the various different BCMA-expressing cells, exhibiting a range of different antigen densities, and not when incubated with target-negative cells. The degree of the RFP reporter signal generally correlated with levels of surface BCMA expression. When incubated with cells in which lower levels of surface BCMA expression were observed, CAR-expressing reporter cells exhibited lower levels of the reporter indicative of activity. Likewise, CAR-expressing reporter cells incubated with cell lines in which higher levels of surface BCMA expression was observed exhibited higher levels of the reporter indicative of activity. Thus, the density of BCMA expression on the surface of the various multiple myeloma cell lines was observed to correlate with the level of a parameter indicative of antigen-specific activity of reporter cells expressing the BCMA-55-LS-O/SSE CAR, indicating that cells expressing the CAR can exhibit activity over a range of antigen densities, and in some aspects can exhibit increased activity with increased antigen levels.

Example 12: Assessment of Nur77-tdTomato Reporter Signal in Reporter Cell Lines Expressing Anti-BCMA Chimeric Antigen Receptors (CARs) Containing Spacers of Different Length Expression of the reporter in cells engineered to express anti-BCMA CARs containing the same antigen-binding domain but spacers of different length was determined after co-culture with target cells. The Jurkat Nur77-tdTomato cells, generated as described in Example 11, were engineered to express BCMA-55-LS-O/SSE CAR (containing a longer spacer derived from modified IgG Hinge-$C_H2$-$C_H3$, set forth in SEQ ID NO:649) or BCMA-55-SS CAR (containing a shorter spacer derived from IgG4 hinge, set forth in SEQ ID NO:363). The cells were co-cultured with human BCMA-expressing K562 target cells (BCMA-K562) target cells at various E:T ratios. Reporter cells expressing a CAR targeting a different antigen (anti-CD19 CAR), were used as control. As shown in FIG. 17, the Nur77-tdTomato expression level was observed to be different in the anti-BCMA CARs containing different spacer lengths, and a dose-dependent response to stimulation with target cells expressing BCMA was observed.

Example 13: Assessment of Antigen-independent (Tonic) Signaling from Different Anti-BCMA Chimeric Antigen Receptors (CARs)

The Nur77-tdTomato reporter cells were transduced with a viral vector encoding anti-CD19 CAR (control), BCMA-55-LS-O/SSE CAR, BCMA-26-LS-O/SSE CAR, BCMA-23-LS-O/SSE CAR, or BCMA-25-LS-O/SSE CAR as described in Example 11 above, with the exception that the surrogate marker for transduction was super-fold green fluorescent protein, sfGFP. In this model, tonic signaling was indicated by tdTomato expression in the absence of BCMA antigen stimulation.

A viral vector encoding an anti-BCMA CAR containing a different anti-BCMA scFv, designated as BCMA-52-LS-O/SSE CAR, also was generated and transduced into the reporter cell. The various CAR-expressing cells were incubated without antigen stimulation to assess the degree of antigen-independent (tonic) signaling for 3 days and evaluated for the expression of tdTomato by flow cytometry.

Figure 18:
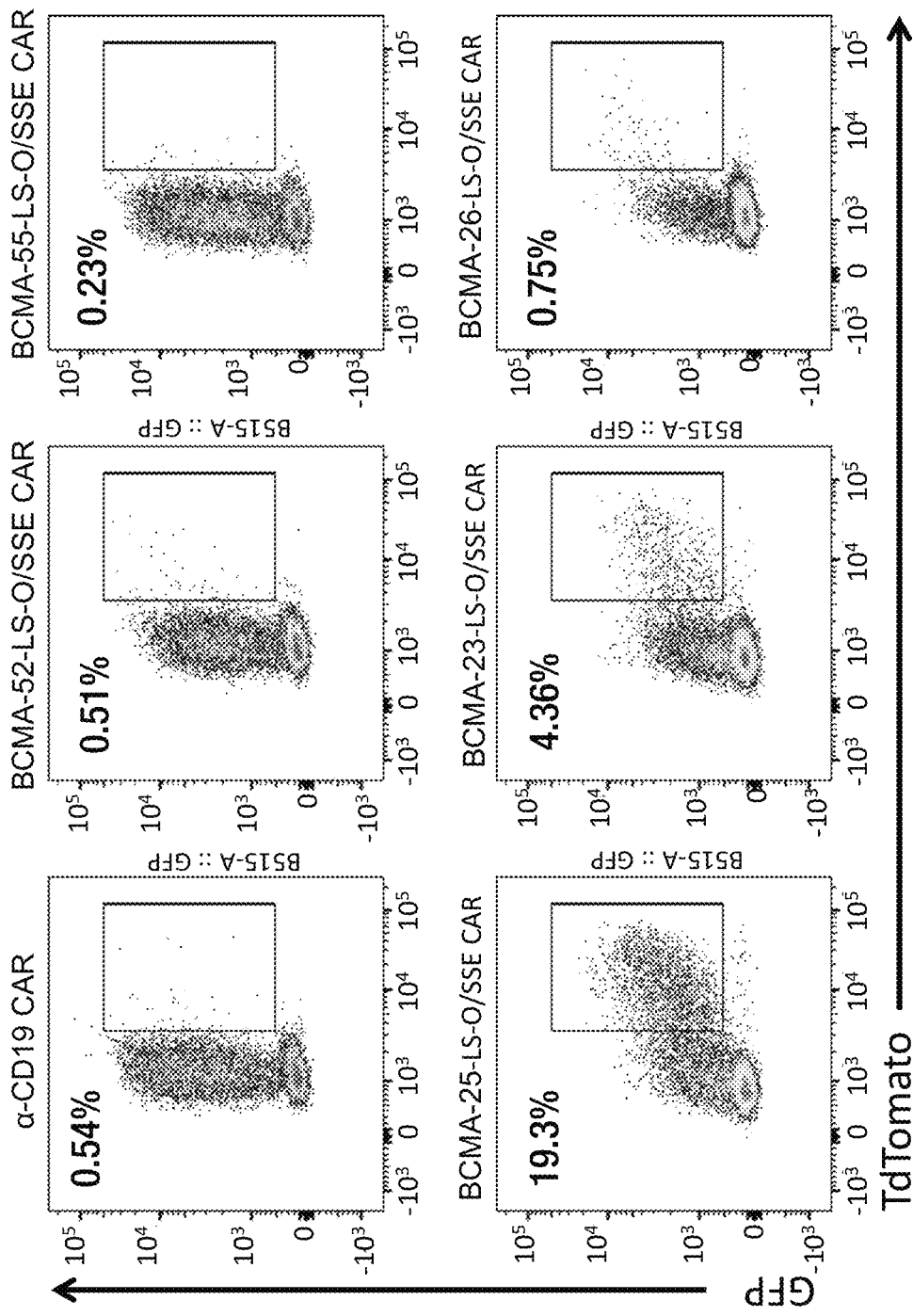
FIG. 18 depicts the expression level of tdTomato and GFP (surrogate marker for CAR expression), as detected by flow cytometry, in reporter cells expressing an anti-CD19 CAR, BCMA-55-LS-O/SSE CAR, BCMA-26-LS-O/SSE CAR, BCMA-23-LS-O/SSE CAR, or BCMA-52-LS-O/SSE CAR, incubated without antigen stimulation to assess the degree of antigen-independent (tonic) signaling for 3 days.

As shown in FIG. 18, various CAR-expressing cell lines exhibited a varying degree of tdTomato expression in the absence of antigen stimulation. The percentage of tdTomato+ cells (indicative of tonic reporter activation) among CAR-expressing cells (indicated by GFP+ cells) varied from 0.23% to 19.3%, in cells expressing different CARs.

Example 14: Assessment of Antigen-independent (Tonic) Signaling from Anti-BCMA Chimeric Antigen Receptors (CARs) Containing Different Intracellular Domains Antigen-independent (tonic) signaling was assessed in reporter cells expressing various CARs containing different intracellular signaling regions. The Nur77-tdTomato reporter cells were transduced with a viral vector encoding anti-CD19 CAR, BCMA-55-LS-O/SSE CAR, BCMA-26-LS-O/SSE CAR, BCMA-23-LS-O/SSE CAR, or BCMA-52-LS-O/SSE CAR, generated generally as described in Example 11 and 13, with the exception that the CARs contained intracellular domains derived from 4-1BB or CD28, and the surrogate marker for transduction was a truncated receptor. The various CAR-expressing cells were incubated without antigen stimulation to assess the degree of antigen-independent (tonic) signaling and evaluated for the expression of tdTomato by flow cytometry.

Figure 19B:
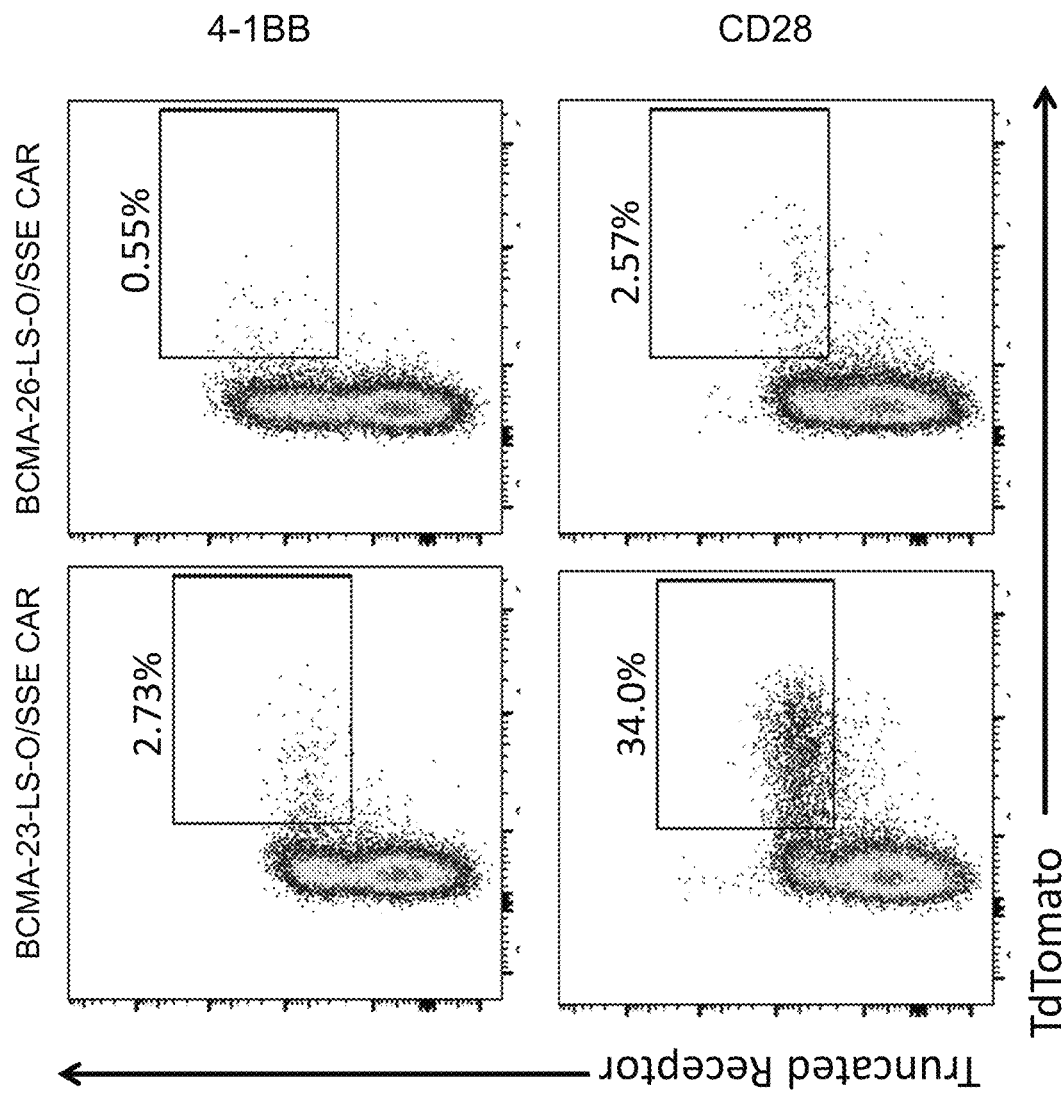

As shown in FIG. 19A and FIG. 19B, the 4-1BB- and CD28-derived intracellular domains in various CARs resulted in different levels of tonic signaling, as indicated by the percentage of tdTomato+ cells among the CAR+ cells (as determined based on expression of the surrogate marker).

Example 15: Assessment of Antigen Cross-Reactivity of Anti-BCMA Chimeric Antigen Receptors (CARs) Using Reporter Cell Line The Nur77-tdTomato cell line engineered to express BCMA-55-LS-O/SSE CAR, specific for human BCMA and generated as generally described in Example 11, was employed to assess species cross reactivity of the antigen-binding domains of CARs. The reporter cell line expressing BCMA-55-LS-O/SSE CAR was co-cultured with K562 human myelogenous leukemia cells expressing human BCMA (huBCMA), murine BCMA (muBCMA) or cynomolgus monkey BCMA (cynoBCMA), at an E:T ratio of 2:1 or 5:1. The percentage of tdTomato+ cells were determined by flow cytometry.

As shown in FIG. 20A, more than 90% of the BCMA-55-LS-O/SSE CAR-expressing cells were observed to be tdTomato+ when cultured with target cells expressing huBCMA, at both E:T ratios tested. In comparison, when cultured with target cells expressing muBCMA, very few cells were tdTomato+, indicating very low cross-reactivity. When cultured with target cells expressing cynoBCMA, approximately 10 to 20% of the cells were tdTomato+, indicating some cross-reactivity by cynoBCMA.

The reporter cell line expressing BCMA-55-LS-O/SSE CAR was incubated with increasing concentrations (0, 0.1, 0.25, 1, 2.5, 10, 25 and 100 µg/mL) of huBCMA and cynoBCMA coated on 96-well flat-bottom plates. The percentage of tdTomato+ cells and the mean fluorescence intensity (MFI) of the tdTomato signal in CAR+ cells were determined.

Figure 20C:
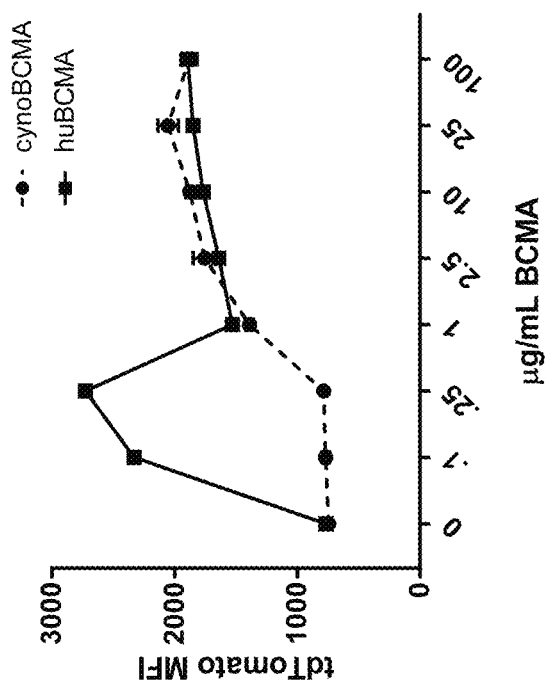
FIGS. 20B and 20C depict the percentage (FIG. 20B) and mean fluorescence intensity (MFI.
Figure 20B:
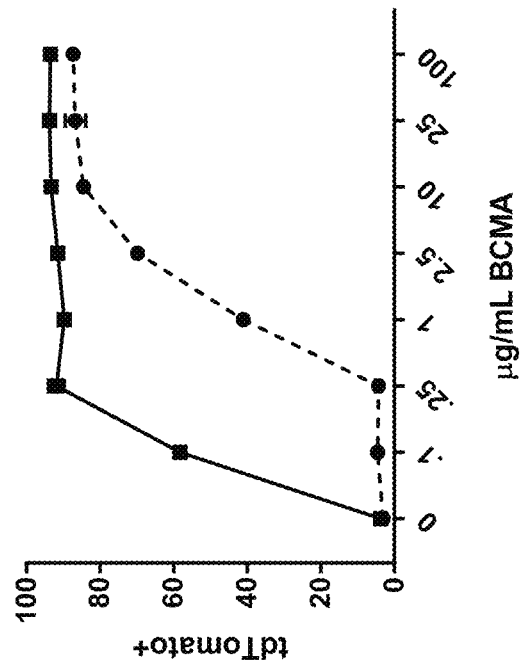

As shown in FIGS. 20B and 20C, cynoBCMA did not cross-react with BCMA-55-LS-O/SSE CAR at low concentrations, but did at high concentrations.

Example 16: Assessment of Antigen Specificity of Anti-BCMA Chimeric Antigen Receptors (CARs) Using Reporter Cell Line The antigen specificity for activation of BCMA-55-LS-O/SSE CAR-expressing cells was tested by comparing the activation of Jurkat Nur77 reporter cells in response to BCMA-expressing MM1S target cells, with K562 target cells engineered to express a non-BCMA protein shown to be recognized at low levels by BCMA-55-scFv Fc in Example 5C, Cathepsin G (CTSG). As a negative control, parental K542 cells also were assessed. Briefly, Nur77 reporter cells, transduced with a viral vector encoding BCMA-55-LS-O/SSE CAR, were incubated 24 hours with the target cells listed above, at 5:1, 1:1, and 1:5 effector: target cell ratios, and activation was determined by measuring the percentage of cells expressing RFP (RFP+) by flow cytometry. The results demonstrated that BCMA-55-LS-O/SSE CAR-expressing cells were activated by BCMA-expressing MM1S cells, but not BCMA-negative target cells (parental or cells expressing the non-BCMA antigen, CTSG).

Example 17: Determining the Binding Epitope for BCMA-52 and BCMA-55 scFvs

Epitopes recognized, e.g., specifically bound to, by exemplary anti-BCMA scFv clones (BCMA-1, BCMA-5, BCMA-9, BCMA-23, BCMA-25, BCMA-26, BCMA-52 and BCMA-55 anti-BCMA scFvs), were assessed using full discontinuous epitope mapping by Chemical Linkage of Peptides onto Scaffolds (CLIPS; Pepscan Presto BV, Lelystad, The Netherlands; see, e.g., Timmerman et al., (2007) J. Mol. Recognit. 20: 283-329). Mapping was carried out using anti-BCMA scFv clones, such as those fused with mouse Fc (scFv-mFc).

Linear and conformational peptide libraries of amino acid residues 1-54 of human BCMA (set forth as amino acid residues 1-54 of SEQ ID NO:367) were generated based on a combinatorial matrix design. Linear peptides and structural mimetics including single loop, α-helix, β-turn, combinatorial and linear disulfide bridge mimics, and discontinuous epitope mimics were used, along with positive and negative control peptides, on an amino-functionalized solid support.

Affinities for binding to the peptides in the epitope library were determined using ELISA. The peptide arrays were incubated with a solution containing the scFv overnight at 4° C. Affinity information was used in iterative screens to define the sequence and conformation of epitopes. Heat maps of affinity information for two or more loops were generated.

scFvs assessed were observed to recognized conformational epitopes that included several discontinuous peptide stretches of the BCMA peptide sequence. BCMA-1, BCMA-5, BCMA-23 and BCMA-25 scFv were observed to bind to a peptide of $_{30}$SNTPPLTCQR$_{39}$ (set forth in SEQ ID NO:379), which could be recognized in a linear form. In some aspects, such antibodies recognize a non-linear or linear epitope including residues of such peptide of SEQ ID NO: 379, and in some aspects to recognize a non-linear epitope further including residues of $_{21}$CIPCQLR$_{27}$ (set forth in SEQ ID NO:375), $_{30}$SNTPPLTCQR$_{39}$ and/or $_{44}$SVTNSVK$_{50}$ (set forth in SEQ ID NO:393). The BCMA-26 scFv was observed to recognize an epitope comprising residues present in $_{8}$CSQNEYF$_{14}$ (set forth in SEQ ID NO:410) and $_{17}$LLHACIPCQLR$_{27}$ (set forth in SEQ ID NO:428). BCMA-52-scFv-mFc was observed to bind to an epitope containing residues of the following discontinuous peptides: $_{10}$QNEYF$_{14}$ (SEQ ID NO:637), $_{21}$CIPCQL$_{26}$ (SEQ ID NO:638), and $_{7}$CQRYC$_{41}$ (SEQ ID NO:639). BCMA-55-scFv-mFc was observed to specifically bind to an epitope containing residues present in peptides comprising discontinuous portions of the BCMA polypeptide sequence, individually comprising the following sequences: $_{1}$MLMAG$_{6}$ (SEQ ID NO:640), $_{13}$YFDSL$_{17}$ (SEQ ID NO:779), and $_{25}$QLRCSSNTPPL$_{35}$ (SEQ ID NO:642). In some embodiments, the provided antibody or receptor specifically binds to an epitope comprising residues present within one or more of, e.g., each of discontinuous peptides having the sequences of: MLMAG (SEQ ID NO:640), YFDSL (SEQ ID NO:779), and QLRCSSNTPPL (SEQ ID NO:642). In some aspects, the provided antibody or receptor specifically binds to an epitope comprising residues present within one or more of, e.g., each of, the following discontinuous peptides having the sequences of: MLMAG (SEQ ID NO:640), YFDSLL (SEQ ID NO:641), and QLRCSSNTPPL (SEQ ID NO:642); in some aspects, the provided antibody or receptor specifically binds to an epitope comprising residues present within one or more of, e.g., each of, the following discontinuous peptides having the sequences of: MLMAG (SEQ ID NO:640), QNEYFDSLL (SEQ ID NO:780), and QLRCSSNTPPL (SEQ ID NO:642).

Example 18: Administration of Anti-BCMA CAR-Expressing Cells to Subjects with Relapsed or Refractory Multiple Myeloma (MM)

Chimeric antigen-receptor (CAR)-expressing T cell compositions containing autologous T cells expressing a CAR specific for B-cell maturation antigen (BCMA) were administered to human subjects with relapsed and/or refractory multiple myeloma (MM).

A. Subjects and Treatment

Compositions containing autologous T cells engineered to express an exemplary CAR specific for BCMA were administered to adult human subjects with relapsed or refractory (R/R) multiple myeloma (MM), who have received 3 or more prior treatments (the 3 or more prior treatments including at least a proteasome inhibitor, an immunomodulatory agent and an anti-CD38 monoclonal antibody, in each case unless the subject was not a candidate to receive such treatment such as by way of it being contraindicated).

The administered T cell compositions had been generated by a process including immunoaffinity-based enrichment of CD4+ and CD8+ cell populations from leukapheresis samples from individual subjects with MM, combining cells of such populations, such as at or at approximately a 1:1 ratio, and subjecting the cells to processing steps including for cell transduction and expansion, and cryopreservation, and generation of cells with a range of CD4+ to CD8+ CAR T cell ratios. The CAR contained a BCMA-55-derived scFv binding domain, a modified IgG-derived $C_H2$-$C_H3$-hinge spacer, a CD28 transmembrane domain, and an intracellular signaling region including, in series, a 4-1BB endodomain and a CD3zeta endodomains. The polynucleotide sequence encoding the anti-BCMA CAR did not include identified potential cryptic splice donor and acceptor sites.

Two to seven days prior to CAR+ T cell infusion (and completed at least 48 hours prior to CAR-T infusion) subjects received a lymphodepleting chemotherapy (LDC) with flurdarabine (flu, 30 mg/m$^2$/day) and cyclophosphamide (Cy, 300 mg/m$^2$/day) for 3 days, the LDC completed at least 48 hours prior to CAR-T infusion. The cryopreserved cell compositions were thawed at bedside prior to intravenous administration, with the day of infusion being designated day 1. On day 1, subjects were administered a dose of CAR-expressing T cells as follows: a single dose of dose level 1 (DL1) containing 5×10$^7$ total CAR-expressing T cells, or a single dose of dose level 2 (DL2) containing 1.5×10$^8$ total CAR-expressing T cells.

At a particular timepoint of analysis, 19 adult subjects had been enrolled in an ongoing clinical study involving such therapy. Of these 19 subjects at this particular timepoint, 13 subjects had been administered the anti-BCMA CAR+ cells, each either at DL1 or DL2. Of these 13 subjects, at this particular timepoint in the ongoing study, 8 subjects were evaluable for attributes indicative of safety (evaluability based on ≥1 mo. follow-up) (n=5 DL1; n=3 DL2). One subject had been unable to receive CAR+ T cells, due to sepsis after LDC, leading to death before CAR+ T cell administration. Three subjects (all DL1) were evaluable at this timepoint for confirmed response (evaluability based on ≥2 mo. follow-up) according to International Myeloma Working Group (IMWG) uniform response criteria (Kumar et al. (2016) Lancet Oncol 17(8):e328-346).

For these 8 subjects assessed at this timepoint, median follow-up was 5 weeks (range 4-13 weeks). Median age was 53 years (range 36-66) with a median time from diagnosis of 4 years (range 2-12). Subjects had received a median of 10 prior regimens (range 4-15) for MM. Of the 8 subjects, 4 (50%) had been refractory (no response or progression within 60 days of last therapy) to bortezomib, carfilzomib, lenalidomide, pomalidomide and an anti-CD38 monoclonal antibody. Seven of the 8 subjects (88%) had had prior autologous stem cell transplant and 4 of 8 (50%) had IMWG high risk cytogenetics.

At the time of the assessment at the timepoint in the ongoing study, no DLTs had been observed in the subjects assessed receiving DL1 or DL2. Cytokine release syndrome (CRS), all grade 1 or 2, had been observed in 6 of the 8 (75%) subjects at the timepoint. Median onset of CRS at the timepoint among the 8 subjects was 9 days (range 4-10) with a median duration of 4.5 days (range 2-19 days). None of the subjects with grade 2 CRS at the timepoint had required vasopressor support and only 1 subject had received tocilizumab. None of the subjects had exhibited CRS of grade 3 or higher. Three of 8 (38%) subjects had experienced neurologic adverse events (AE). Two of the eight subjects at the timepoint had exhibited grade 1 events, and 1 had exhibited a grade 3 event (lethargy), which had resolved within 24 hours after receiving steroids. Onset of neurologic AEs was 9, 11 and 12 days, with a duration of 2, 3 and 1 days, respectively, for the 3 subjects experiencing neurological AE. The subject who had experienced grade 3 neurotoxicity (NT) as-of the analysis at this timepoint had developed secondary plasma cell leukemia (PCL) just prior to receiving LDC.

All 8 subjects at the timepoint were observed to have had evidence of objective response, including the subject with secondary PCL. Three subjects, all administered DL1, were observed to have achieved confirmed responses (1 partial response, PR; 2 stringent complete response, sCR), whereas the remaining subjects remained unconfirmed (1 complete response, CR; 2 very good partial response, VGPR; 1 PR, 1 MR). As of the timepoint for assessment, no subject had been observed to have progressed.

The results showed that at the assessed dose levels, administration of the anti-BCMA CAR cell therapy exhibited favorable safety profiles, with no DLTs reported at this timepoint in an ongoing clinical study. The results were consistent with a conclusion that at this timepoint the incidence of grade 3 or higher NT was low, and no grade 3 or higher CRS had been observed with clinical response.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

| SEQUENCES | | |
|---|---|---|
| SEQ ID NO | SEQUENCE | Description |
| 1 | DYAMS | BCMA-1, -3, -4, -5, -6, -7, -8, -25, -31, -42, -44, -45, -46, -51 CDR-H1 (aa) Kabat numbering |
| 2 | DYYMS | BCMA-2, -9, -10, -12, -17, -21, -22, -23, -24, |

| SEQ ID NO | SEQUENCE | Description |
|---|---|---|
| | | -26, -32, -33, -35, -36, -37, -38, -40, -41, -47, -48, -49 CDR-H1 (aa) Kabat numbering |
| 3 | DYAMH | BCMA-11, -20, -27, -28, -29, -30, -34, -39 CDR-H1 (aa) Kabat numbering |
| 4 | FIRSKAYGGTTEYAASVKG | BCMA-1, -3, -4, -5, -6, -7, -8, -25, -31, -42, -44, -45, -46, -51 CDR-H2 (aa) Kabat numbering |
| 5 | YISSSGSTIYYADSVKG | BCMA-2, -9, -10, -12, -17, -21, -22, -23, -26, -32, -35, -36, -37, -38, -40, -47, -48, -49 CDR-H2 (aa) Kabat numbering |
| 6 | GISWNSGSIGYADSVKG | BCMA-11, -20, -24, -27, -29, -30, -34, -39 CDR-H2 (aa) Kabat numbering |
| 7 | WSAPTDY | BCMA-1, -3, -4, -5, -6, -7, -8, -25, -31, -42, -44, -45, -46, -51 and VH-2 CDR-H3 (aa) |
| 8 | VDGPPSSDI | BCMA-2 CDR-H3 (aa) |
| 9 | VDGDYVDDY | BCMA-9, -36, -37, -38, -41 and VH-8 CDR-H3 (aa) |
| 10 | VDGPPSFDI | BCMA-10, -12, -26, -32, -47, -48, -49 and VH-1 CDR-H3 (aa) |
| 11 | DLGPDYDPDAFDI | BCMA-11, -34 CDR-H3 (aa) |
| 12 | GFTFGDY | BCMA-1, -3, -4, -5, -6, -7, -8, -25, -30, -31, -42, -44, -45, -46, -51 CDR-H1 (aa) Chothia numbering |
| 13 | GFTFSDY | BCMA-2, -9, -12, -17, -21, -22, -23, -24, -26, -32, -33, -35, -36, -37, -38, -40, -41, -47, -48, -49 CDR-H1 (aa) Chothia numbering |
| 14 | GFPFSDY | BCMA-10 CDR-H1 (aa) Chothia numbering |
| 15 | GFTFDDY | BCMA-11, -20, -27, -28, -29, -34, -39 CDR-H1 (aa) Chothia numbering |
| 16 | RSKAYGGT | BCMA-1, -3, -4, -5, -6, -7, -8, -25, -31, -42, -44, -45, -46, -51 CDR-H2 (aa) Chothia numbering |
| 17 | SSSGST | BCMA-2, -9, -10, -12, -17, -21, -22, -23, -26, -32, -35, -36, -37, -38, -40, -47, -48 CDR-H2 (aa) Chothia numbering |

-continued

| SEQ ID NO | SEQUENCE | Description |
|---|---|---|
| 18 | SWNSGS | BCMA-11, -20, -24, -27, -29, -30, -34, -39 CDR-H2 (aa) Chothia numbering |
| 19 | GFTFGDYAMS | BCMA-1, -3, -4, -5, -6, -7, -8, -25, -31, -42, -44, -45, -46, -51 CDR-H1 (aa) AbM numbering |
| 20 | GFTFSDYYMS | BCMA-2, -9, -12, -17, -21, -22, -23, -24, -26, -32, -33, -35, -36, -37, -38, -40, -41, -47, -48, -49 CDR-H1 (aa) AbM numbering |
| 21 | GFPFSDYYMS | BCMA-10 CDR-H1 (aa) AbM numbering |
| 22 | GFTFDDYAMH | BCMA-11, -20, -27, -28, -29, -34, -39 CDR-H1 (aa) AbM numbering |
| 23 | FIRSKAYGGTTE | BCMA-1, -3, -4, -5, -6, -7, -8, -25, -31, -42, -44, -45, -46, -51 CDR-H2 (aa) AbM numbering |
| 24 | YISSSGSTIY | BCMA-2, -9, -10, -12, -17, -21, -22, -23, -26, -32, -35, -36, -37, -38, -40, -47, -48, -49 CDR-H2 (aa) AbM numbering |
| 25 | GISWNSGSIG | BCMA-11, -20, -24, -27, -29, -30, -34, -39 CDR-H2 (aa) AbM numbering |
| 26 | KSSQSVLSTSNNKNYLA | BCMA-1 CDR-L1 (aa) |
| 27 | RASQSIKTNLA | BCMA-2 CDR-L1 (aa) |
| 28 | KSSQSVLHSSNNKNYLA | BCMA-3, -46 CDR-L1 (aa) |
| 29 | RASQDIRNSLA | BCMA-4 CDR-L1 (aa) |
| 30 | KSSQSVLYSSNNKNYLA | BCMA-5, -8, -24 CDR-L1 (aa) |
| 31 | RASQSISNSLA | BCMA-6 CDR-L1 (aa) |
| 32 | RASQDIGDYLA | BCMA-7 CDR-L1 (aa) |
| 33 | GANNIGSKSVH | BCMA-9, -26, -35 CDR-L1 (aa) |
| 34 | GGNNIERKNVH | BCMA-10 CDR-L1 (aa) |
| 35 | SGSSSNIGSNAVN | BCMA-11 CDR-L1 (aa) |
| 36 | SGSRSNIGNNYVS | BCMA-12 CDR-L1 (aa) |
| 37 | WASTREA | BCMA-1 CDR-L2 (aa) |
| 38 | AASTRAT | BCMA-2 CDR-L2 (aa) |
| 39 | WASTRES | BCMA-3, -5, -8, -31, -44, -46 CDR-L2 (aa) |
| 40 | AASRLES | BCMA-4, -42 CDR-L2 (aa) |

-continued

| SEQ ID NO | SEQUENCE | Description |
|---|---|---|
| 41 | AASNVED | BCMA-6 CDR-L2 (aa) |
| 42 | VASTLQS | BCMA-7 CDR-L2 (aa) |
| 43 | DDDDRPS | BCMA-9, -26, -35 CDR-L2 (aa) |
| 44 | DDSDRAS | BCMA-10 CDR-L2 (aa) |
| 45 | NSHQRPS | BCMA-11 CDR-L2 (aa) |
| 46 | DNAKRPS | BCMA-12 CDR-L2 (aa) |
| 47 | QQYFSSPYT | BCMA-1 CDR-L3 (aa) |
| 48 | QQYGSSPT | BCMA-2 CDR-L3 (aa) |
| 49 | QQYYTTPLT | BCMA-3, -46 CDR-L3 (aa) |
| 50 | QQYYSLPLS | BCMA-4 CDR-L3 (aa) |
| 51 | QQYYSTPWT | BCMA-5 CDR-L3 (aa) |
| 52 | QQSHMYPPT | BCMA-6 CDR-L3 (aa) |
| 53 | QQYHSHPWT | BCMA-7 CDR-L3 (aa) |
| 54 | QQYYSTPYT | BCMA-8, -31 CDR-L3 (aa) |
| 55 | HVWDRSRDHYV | BCMA-9 CDR-L3 (aa) |
| 56 | QAWDSSSTLYV | BCMA-10 CDR-L3 (aa) |
| 57 | AAWDDSLRGYV | BCMA-11 CDR-L3 (aa) |
| 58 | QVWDSSSDHWV | BCMA-12, -32, -48 CDR-L3 (aa) |
| 59 | QVQLVQSGGGLVQPGRSLRLSCTASGFTFG | BCMA-1, -3, -4, -5, -6, -7, -8, -45, -46 VH FR1 (aa) |
| 60 | EVQLVESGGGLVKPGGSLRLSCAASGFTFS | 26, -40, -48 VH FR1 (aa) |
| 61 | EVQLVQSGGGLVKPGGSLRLSCAASGFTFS | BCMA-9, -24, -35, -37 VH FR1 (aa) |
| 62 | EVQLVESGGGLVKPGGSLRLSCAASGFPFS | BCMA-10 VH FR1 (aa) |
| 63 | QVQLVQSGGGLVQPGRSLRLSCAASGFTFD | BCMA-11, -28, -29, -39 VH FR1 (aa) |
| 64 | WFRQAPGKGLEWVG | BCMA-1, -3, -4, -5, -6, -7, -8, -25, -31, -42, -44, -45, -46, -51 VH FR2 (aa) |
| 65 | WIRQAPGKGLEWVS | BCMA-2, -9, -10, -12, -21, -22, -23, -24, -26, -32, -33, -35, -36, -37, -38, -40, -41, -47, -48, -49 VH FR2 (aa) |
| 66 | WVRRAPGKGLEWVS | BCMA-11 VH FR2 (aa) |
| 67 | RFTISRDDSKSIAYLQMNSLKTEDTAVYYCAA | BCMA-1, -3, -4, -5, -6, -7, -8, -25, -31, -42, -44, -45, -46, -51 VH FR3 (aa) |

| SEQ ID NO | SEQUENCE | Description |
|---|---|---|
| 68 | RFTISRDNAKNSLYLQMNSLRAEDTAVYYCAK | BCMA-2, -10, -12, -21, -22, -23, -26, -32, -40, -41, -48, -49 VH FR3 (aa) |
| 69 | RFTISRDNAKNSLYLQMNSLRAEDTAVYYCAR | BCMA-9, -11, -17, -24, -28, -29, -30, -33, -34, -35, -36, -38, -39 VH FR3 (aa) |
| 70 | WGQGTLVTVSS | BCMA-1, -3, -4, -5, -6, -7, -8, -9, -15, -16, -18, -20, -21, -22, -23, -25, -27, -31, -35, -36, -37, -38, -40, -41, -42, -44, -45, -46, -51 VH FR4 (aa) |
| 71 | WGQGTMVTVSS | BCMA-2, -10, -11, -12, -24, -26, -29, -30, -32, -34, -39, -48, -49, -50 VH FR4 (aa) |
| 72 | DIVMTQSPDSLSVSPGERATISC | BCMA-1 VL FR1 (aa) |
| 73 | EIVMTQSPATLSVSPGETATLSC | BCMA-2 VL FR1 (aa) |
| 74 | DIVMTQSPDSLVVSLGERATINC | BCMA-3, -46 VL FR1 (aa) |
| 75 | AIRMTQSPSSLSASLGDRVTITC | BCMA-4 VL FR1 (aa) |
| 76 | DIVMTQSPDSLAVSLGERATINC | BCMA-5, -8, -24 VL FR1 (aa) |
| 77 | DIVMTQSPSSLSVSVGERVTITC | BCMA-6 VL FR1 (aa) |
| 78 | VIQLTQSPSSLSASVGDRVTITC | BCMA-7 VL FR1 (aa) |
| 79 | SYELTQPPSVSVAPGQTARVTC | BCMA-9 VL FR1 (aa) |
| 80 | SYVLTQPPSVSVAPGQTARITC | BCMA-10, -26 VL FR1 (aa) |
| 81 | QLVLTQPPSASGTPGQRVTISC | BCMA-11 VL FR1 (aa) |
| 82 | QSALTQPPSVSAAPGQKVTISC | BCMA-12 VL FR1 (aa) |
| 83 | WYQQKPGQPPRLLLY | BCMA-1 VL FR2 (aa) |
| 84 | WYQQKPGQAPRLLIY | BCMA-2, -34 VL FR2 (aa) |
| 85 | WYQQKPGQPPKLLIY | BCMA-3, -5, -8, -24, -44, -46 VL FR2 (aa) |
| 86 | WYQQRPGKAPKLLLS | BCMA-4 VL FR2 (aa) |
| 87 | WYKQRPGEAPKLLIH | BCMA-6 VL FR2 (aa) |
| 88 | WFQQRPGKAPKSLIY | BCMA-7 VL FR2 (aa) |
| 89 | WYQQKPGQAPMLVVY | BCMA-9, -26, -35 VL FR2 (aa) |
| 90 | WYQQKPGQAPVPVVY | BCMA-10 VL FR2 (aa) |
| 91 | WYQQLPGTAPEVLIY | BCMA-11 VL FR2 (aa) |
| 92 | WYQQLPGTAPKLLIY | BCMA-12 VL FR2 (aa) |
| 93 | GVPDRFSGSGSGTDFTLTISSLQAEDVAVYYC | BCMA-1, -3, -5, -8, -31, -44, -46 VL FR3 (aa) |

-continued

| SEQ ID NO | SEQUENCE | Description |
|---|---|---|
| 94 | GIPDRFSGSGSGTDFTLTITRLEPEDFAVYYC | BCMA-2 VL FR3 (aa) |
| 95 | GVPSRFSGTTSGAEYALSISSLQPEDVASYFC | BCMA-4 VL FR3 (aa) |
| 96 | GVPSRFSGRGSGTVFTLAISNVQPEDFATYYC | BCMA-6 VL FR3 (aa) |
| 97 | GVPSRFSGSGSGTHFTLTINSLQPEDFATYYC | BCMA-7 VL FR3 (aa) |
| 98 | GIPERFSGSNSGNTATLTISGVEAGDEADYFC | BCMA-9, -26, -35 VL FR3 (aa) |
| 99 | GIPERFSASNSGNTATLTISGAQATDEAEYYC | BCMA-10 VL FR3 (aa) |
| 100 | GVPDRFSGSKSGTSASLAINGLQSEDEADYYC | BCMA-11 VL FR3 (aa) |
| 101 | GIPDRFSGSKSGTSATLDIAGLQTGDEADYYC | BCMA-12 VL FR3 (aa) |
| 102 | FGHGTKLEIK | BCMA-1 VL FR4 (aa) |
| 103 | FGRGTKLEIK | BCMA-2, -39 VL FR4 (aa) |
| 104 | FGGGTKVEIK | BCMA-3, -4, -6, -30, -46 VL FR4 (aa) |
| 105 | FGQGTKVDIK | BCMA-5, -45 VL FR4 (aa) |
| 106 | FGPGTKVDIK | BCMA-7 VL FR4 (aa) |
| 107 | FGQGTKLEIK | BCMA-8, -44 VL FR4 (aa) |
| 108 | FGTGTKLTVL | BCMA-9, -10, -11, -26, -40, -47 VL FR4 (aa) |
| 109 | FGGGTKLTVL | BCMA-12, -14, -15, -16, -17, -18, -32, -33, -36, -37, -38, -41, -48, -49, -50 VL FR4 (aa) |
| 110 | QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSS | BCMA-1, -3, -4, -5, -6, -7, -8, -45, -46 VH Chain (aa) |
| 111 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSSDIWGQGTMVTVSS | BCMA-2 $V_H$ Chain (aa) |
| 112 | EVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYVDDYWGQGTLVTVSS | BCMA-9 $V_H$ Chain (aa) |
| 113 | EVQLVESGGGLVKPGGSLRLSCAASGFPFSDYYMSWIRQAPGKGLEWVSYISSSGSTIYYADSVKGRFTISRDNAKNSLYLQMNSLRAEDTAVYYCAKVDGPPSFDIWGQGTMVTVSS | BCMA-10 $V_H$ Chain (aa) |
| 114 | QVQLVQSGGGLVQPGRSLRLSCAASGFTFDDYAMHWVRRAPGKGLEWVSGISWNSGSIGYADSVKGRFTISRDNAKNSLYLQMNSSLRAEDTAVYYCARDLGPDYDPDAFDIWGQGTMVTVS | BCMA-11 $V_H$ Chain (aa) |
| 115 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSS | BCMA-12, -26, -48 $V_H$ Chain (aa) |
| 116 | DIVMTQSPDSLSVSPGERATISCKSSQSVLSTSNNKNYLAWYQQKPGQPPRLLLYWASTREAGVPDRFSGSGSGTDFTLTISSLQAEDVAVYYCQQYFSSPYTFGHGTKLEIK | BCMA-1 $V_L$ Chain (aa) |
| 117 | EIVMTQSPATLSVSPGETATLSCRASQSIKTNLAWYQQKPGQAPRLLIYAASTRATGIPDRFSGSGSGTDFTLTITRLEPEDFAVYYCQQYGSSPTFGRGTKLEIK | BCMA-2 $V_L$ Chain (aa) |
| 118 | DIVMTQSPDSLVVSLGERATINCKSSQSVLHSSNNKNYLAWYQQKPGQPPKLLIYWASTRESGVPDRFSGSGSGTDFTLTISSLQAEDVAVYYCQQYYTTPLTFGGGTKVEIK | BCMA-3, -46 VL Chain (aa) |
| 119 | AIRMTQSPSSLSASLGDRVTITCRASQDIRNSLAWYQQRPGKAPKLLLSAASRLESGVPSRFSGTTSGAEYALSISSLQPEDVASYFCQQYYSLPLSFGGGTKVEIK | BCMA-4 $V_L$ Chain (aa) |

| SEQ ID NO | SEQUENCE | Description |
|---|---|---|
| 120 | DIVMTQSPDSLAVSLGERATINCKSSQSVLYSSNNKNYLAWYQQKPGQPPKLLIYWASTRES GVPDRFSGSGSGTDFTLTISSLQAEDVAVYYCQQYYSTPWTFGQGTKVDIK | BCMA-5 V$_L$ Chain (aa) |
| 121 | DIVMTQSPSSLSVSVGERVTITCRASQSISNSLAWYKQRPGEAPKLLIHAASNVEDGVPSRF SGRGSGTVFTLAISNVQPEDFATYYCQQSHMYPPTFGGGTKVEIK | BCMA-6 V$_L$ Chain (aa) |
| 122 | VIQLTQSPSSLSASVGDRVTITCRASQDIGDYLAWFQQRPGKAPKSLIYVASTLQSGVPSRF SGSGSGTHFTLTINSLQPEDFATYYCQQYHSHPWTFGPGTKVDIK | BCMA-7 V$_L$ Chain (aa) |
| 123 | DIVMTQSPDSLAVSLGERATINCKSSQSVLYSSNNKNYLAWYQQKPGQPPKLLIYWASTRES GVPDRFSGSGSGTDFTLTISSLQAEDVAVYYCQQYYSTPYTFGQGTKLEIK | BCMA-8 V$_L$ Chain (aa) |
| 124 | SYELTQPPSVSVAPGQTARVTCGANNIGSKSVHWYQQKPGQAPMLVVYDDDDRPSGIPERFS GSNSGNTATLTISGVEAGDEADYFCHVWDRSRDHYVFGTGTKLTVL | BCMA-9 V$_L$ Chain (aa) |
| 125 | SYVLTQPPSVSVAPGQTARITCGGNNIERKNVHWYQQKPGQAPVPVVYDDSDRASGIPERFS ASNSGNTATLTISGAQATDEAEYYCQAWDSSSTLYVFGTGTKLTVL | BCMA-10 V$_L$ Chain (aa) |
| 126 | QLVLTQPPSASGTPGQRVTISCSGSSSNIGSNAVNWYQQLPGTAPEVLIYNSHQRPSGVPDR FSGSKSGTSASLAINGLQSEDEADYYCAAWDDSLRGYVFGTGTKLTVL | BCMA-11 V$_L$ Chain (aa) |
| 127 | QSALTQPPSVSAAPGQKVTISCSGSRSNIGNNYVSWYQQLPGTAPKLLIYDNAKRPSGIPDR FSGSKSGTSATLDIAGLQTGDEADYYCQVWDSSSDHWVFGGGTKLTVL | BCMA-12 V$_L$ Chain (aa) |
| 128 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDIVMTQSPDSLSVSPGERATISCKSSQSVLSTSNNKNYLAWYQQKPGQPPRLL LYWASTREAGVPDRFSGSGSGTDFTLTISSLQAEDVAVYYCQQYFSSPYTFGHGTKLEIK | BCMA-1 scFv (aa) |
| 129 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGPPSSDIWGQGTMVTVSSGGGGSG GGGSGGGGSEIVMTQSPATLSVSPGETATLSCRASQSIKTNLAWYQQKPGQAPRLLIYAAST RATGIPDRFSGSGSGTDFTLTITRLEPEDFAVYYCQQYGSSPTFGRGTKLEIK | BCMA-2 scFv (aa) |
| 130 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDIVMTQSPDSLVVSLGERATINCKSSQSVLHSSNNKNYLAWYQQKPGQPPKLL IYWASTRESGVPDRFSGSGSGTDFTLTISSLQAEDVAVYYCQQYYTTPLTFGGGTKVEIK | BCMA-3, 46 scFv (aa) |
| 131 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSAIRMTQSPSSLSASLGDRVTITCRASQDIRNSLAWYQQRPGKAPKLLLSAASR LESGVPSRFSGTTSGAEYALSISSLQPEDVASYFCQQYYSLPLSFGGGTKVEIK | BCMA-4 scFv (aa) |
| 132 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDIVMTQSPDSLAVSLGERATINCKSSQSVLYSSNNKNYLAWYQQKPGQPPKLL IYWASTRESGVPDRFSGSGSGTDFTLTISSLQAEDVAVYYCQQYYSTPWTFGQGTKVDIK | BCMA-5 scFv (aa) |
| 133 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDIVMTQSPSSLSVSVGERVTITCRASQSISNSLAWYKQRPGEAPKLLIHAASN VEDGVPSRFSGRGSGTVFTLAISNVQPEDFATYYCQQSHMYPPTFGGGTKVEIK | BCMA-6 scFv (aa) |
| 134 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSVIQLTQSPSSLSASVGDRVTITCRASQDIGDYLAWFQQRPGKAPKSLIYVAST LQSGVPSRFSGSGSGTHFTLTINSLQPEDFATYYCQQYHSHPWTFGPGTKVDIK | BCMA-7 scFv (aa) |
| 135 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDIVMTQSPDSLAVSLGERATINCKSSQSVLYSSNNKNYLAWYQQKPGQPPKLL IYWASTRESGVPDRFSGSGSGTDFTLTISSLQAEDVAVYYCQQYYSTPYTFGQGTKLEIK | BCMA-8 scFv (aa) |
| 136 | EVQLVQSGGGLVKPGGSLRLSCAASGFTFSDYYMSWIRQAPGKGLEWVSYISSSGSTIYYAD SVKGRFTISRDNAKNSLYLQMNSLRAEDTAVYYCARVDGDYVDDYWGQGTLVTVSSGGGGSG GGGSGGGGSSYELTQPPSVSVAPGQTARVTCGANNIGSKSVHWYQQKPGQAPMLVVYDDDDR PSGIPERFSGSNSGNTATLTISGVEAGDEADYFCHVWDRSRDHYVFGTGTKLTVL | BCMA-9 scFv (aa) |

-continued

| SEQ ID NO | SEQUENCE | Description |
|---|---|---|
| 137 | EVQLVESGGGLVKPGGSLRLSCAASGFPFSDYYMSWIRQAPGKGLEWVSYISSSGSTIYYAD SVKGRFTISRDNAKNSLYLQMNSLRAEDTAVYYCAKVDGPPSFDIWGQGTMVTVSSGGGGSG GGGSGGGGSSYVLTQPPSVSVAPGQTARITCGGNNIERKNVHWYQQKPGQAPVPVVYDDSDR ASGIPERFSASNSGNTATLTISGAQATDEAEYYCQAWDSSSTLYVFGTGTKLTVL | BCMA-10 scFv (aa) |
| 138 | QVQLVQSGGGLVQPGRSLRLSCAASGFTFDDYAMHWVRRAPGKGLEWVSGISWNSGSIGYAD SVKGRFTISRDNAKNSLYLQMNSLRAEDTAVYYCARDLGPDYDPDAFDIWGQGTMVTVSSGG GGSGGGGSGGGGSQLVLTQPPSASGTPGQRVTISCSGSSSNIGSNAVNWYQQLPGTAPEVLI YNSHQRPSGVPDRFSGSKSGTSASLAINGLQSEDEADYYCAAWDDSLRGYVFGTGTKLTVL | BCMA-11 scFv (aa) |
| 139 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGPPSFDIWGQGTMVTVSSGGGGSG GGGSGGGGSQSALTQPPSVSAAPGQKVTISCSGSRSNIGNNYVSWYQQLPGTAPKLLIYDNA KRPSGIPDRFSGSKSGTSATLDIAGLQTGDEADYYCQVWDSSSDHWVFGGGTKLTVL | BCMA-12 scFv (aa) |
| 140 | SYAMH | BCMA-13 CDR-H1 (aa) Kabat numbering |
| 141 | SYGMH | BCMA-14, -15 CDR-H1 (aa) Kabat numbering |
| 142 | SSAMQ | BCMA-16 CDR-H1 (aa) Kabat numbering |
| 143 | SYWMS | BCMA-18 CDR-H1 (aa) Kabat numbering |
| 144 | SYYMH | BCMA-19 CDR-H1 (aa) Kabat numbering |
| 145 | VISYDGSNKYYADSVKG | BCMA-13, -14, -15 CDR-H2 (aa) Kabat numbering |
| 146 | WIVVGSGNTNYAQKFQE | BCMA-16 CDR-H2 (aa) Kabat numbering |
| 147 | HINQDGSEKYYVDSVKG | BCMA-18 CDR-H2 (aa) Kabat numbering |
| 148 | WINPNSGGTNYAQKFQG | BCMA-19 CDR-H2 (aa) Kabat numbering |
| 149 | LPGRDGYPGAFDY | BCMA-13, -14 CDR-H3 (aa) |
| 150 | DQYSSSAQRADFDY | BCMA-15 CDR-H3 (aa) |
| 151 | APYYDILTGYYL | BCMA-16 CDR-H3 (aa) |
| 152 | EADSSADY | BCMA-17, -33 CDR-H3 (aa) |
| 153 | WLAVTN | BCMA-18 CDR-H3 (aa) |
| 154 | DGGDV | BCMA-19 CDR-H3 (aa) |
| 155 | GGLGITPYYFDY | BCMA-20, -27 CDR-H3 (aa) |
| 156 | VDGGYTEDY | BCMA-21 CDR-H3 (aa) |
| 157 | VDGDYTEDY | BCMA-22, -23, -40 CDR-H3 (aa) |
| 158 | GFTFSSY | BCMA-13, -14, -15, -18 CDR-H1 (aa) Chothia numbering |
| 159 | GFTFTSS | BCMA-16 CDR-H1 (aa) Chothia numbering |
| 160 | GYTFTSY | BCMA-19 CDR-H1 (aa) Chothia numbering |

-continued

| SEQ ID NO | SEQUENCE | Description |
|---|---|---|
| 161 | SYDGSN | BCMA-13, -14, -15 CDR-H2 (aa) Chothia numbering |
| 162 | VVGSGN | BCMA-16 CDR-H2 (aa) Chothia numbering |
| 163 | NQDGSE | BCMA-18 CDR-H2 (aa) Chothia numbering |
| 164 | NPNSGG | BCMA-19 CDR-H2 (aa) Chothia numbering |
| 165 | GFTFSSYAMH | BCMA-13 CDR-H1 (aa) AbM numbering |
| 166 | GFTFSSYGMH | BCMA-14, -15 CDR-H1 (aa) AbM numbering |
| 167 | GFTFTSSAMQ | BCMA-16 CDR-H1 (aa) AbM numbering |
| 168 | GFTFSSYWMS | BCMA-18 CDR-H1 (aa) AbM numbering |
| 169 | GYTFTSYYMH | BCMA-19 CDR-H1 (aa) AbM numbering |
| 170 | VISYDGSNKY | BCMA-13, -14, -15 CDR-H2 (aa) AbM numbering |
| 171 | WIVVGSGNTN | BCMA-16 CDR-H2 (aa) AbM numbering |
| 172 | HINQDGSEKY | BCMA-18 CDR-H2 (aa) AbM numbering |
| 173 | WINPNSGGTN | BCMA-19 CDR-H2 (aa) AbM numbering |
| 174 | GSGSNIGSNDVS | BCMA-13, -14, -15, -16, -18, -21 CDR-L1 (aa) |
| 175 | GGNNIGFKGVQ | BCMA-17, -33 CDR-L1 (aa) |
| 176 | TGTSSDVGDYNYVA | BCMA-19 CDR-L1 (aa) |
| 177 | SGGKTVN | BCMA-20, -27 CDR-L1 (aa) |
| 178 | TGSSSDVGKYNLVS | BCMA-22, -23 CDR-L1 (aa) |
| 179 | WNDQRPS | BCMA-13, -14, -15, -16, -18, -21 CDR-L2 (aa) |
| 180 | DDSDRPS | BCMA-17, -32, -33 CDR-L2 (aa) |
| 181 | EVINRPS | BCMA-19 CDR-L2 (aa) |
| 182 | SNDQRPS | BCMA-20, -27 CDR-L2 (aa) |
| 183 | DVNKRPS | BCMA-22, -23, -40 CDR-L2 (aa) |
| 184 | AAWDDSLGGSWV | BCMA-13 CDR-L3 (aa) |
| 185 | AAWDDRLNGFWV | BCMA-14 CDR-L3 (aa) |

| SEQ ID NO | SEQUENCE | Description |
|---|---|---|
| 186 | AAWDDSLSGWV | BCMA-15 CDR-L3 (aa) |
| 187 | ASWDDSLSGWV | BCMA-16 CDR-L3 (aa) |
| 188 | QVWDSASDHWV | BCMA-17, -33 CDR-L3 (aa) |
| 189 | AAWDDSLNGWV | BCMA-18 CDR-L3 (aa) |
| 190 | ISYSRGSTPYV | BCMA-19 CDR-L3 (aa) |
| 191 | GSWDDSLNAWV | BCMA-20, -27 CDR-L3 (aa) |
| 192 | AAWDDSLNGYV | BCMA-21 CDR-L3 (aa) |
| 193 | CSYGGSRSYV | BCMA-22, -40 CDR-L3 (aa) |
| 194 | SSYGGSRSYV | BCMA-23 CDR-L3 (aa) |
| 195 | QMQLVQYGGGVVQPGRSLRLSCAASGFTFS | BCMA-13 VH FR1 (aa) |
| 196 | EVQLLESGGGVVQPGRSLRLSCAASGFTFS | BCMA-14 VH FR1 (aa) |
| 197 | QVQLLESGGGLVKPGGSLRLSCAASGFTFS | BCMA-15, -47 VH FR1 (aa) |
| 198 | EVQLVQSGPEVKKPGTSVKVSCKASGFTFT | BCMA-16 VH FR1 (aa) |
| 199 | QVQLVQSGGGLVKPGGSLRLSCAASGFTFS | BCMA-17, -33, -36, -38, -41 VH FR1 (aa) |
| 200 | EVQLLESGGGLVQPGGSLRLSCAASGFTFS | BCMA-18 VH FR1 (aa) |
| 201 | QVQLVQSGAEVKKPGASVKVSCKASGYTFT | BCMA-19 VH FR1 (aa) |
| 202 | EVQLLESGGGLVQPGRSLRLSCAASGFTFD | BCMA-20 VH FR1 (aa) |
| 203 | EVQLVESGGGLVKPGGSLKLSCAASGFTFS | BCMA-21 VH FR1 (aa) |
| 204 | WVRQAPGKGLEWVA | BCMA-13, -14, -15 VH FR2 (aa) |
| 205 | WVRQARGQRLEWIG | BCMA-16 VH FR2 (aa) |
| 206 | WIRLAPGKGLEWVS | BCMA-17 VH FR2 (aa) |
| 207 | WHRQAPGKGPEWVA | BCMA-18 VH FR2 (aa) |
| 208 | WVRQAPGQGLEWMG | BCMA-19 VH FR2 (aa) |
| 209 | WVRQAPGKGLEWVS | BCMA-20, -27, -28, -29, -30, -34, -39 VH FR2 (aa) |
| 210 | RFTISRDNSKNTLYLQMNSLKAEDTAVYYCAT | BCMA-13 VH FR3 (aa) |
| 211 | RFTISRDNSKNTLYLQMNSLRAEDTAVYYCAT | BCMA-14 VH FR3 (aa) |
| 212 | RFTISRDNSKNTLYLQMNSLRAEDTAVYYCAK | BCMA-15 VH FR3 (aa) |
| 213 | RVTITRDMSTSTAYMELSSLRSEDTAVYYCAA | BCMA-16 VH FR3 (aa) |
| 214 | RFTISRDNAESSLYLQMNSLRAEDTAVYYCAR | BCMA-18 VH FR3 (aa) |
| 215 | RVTMTRDTSISTAYMELSRLRSDDTAVYYCAR | BCMA-19 VH FR3 (aa) |
| 216 | RFTISRDNAKNSLYLQMNSLRAEDTALYYCAK | BCMA-20, -27 VH FR3 (aa) |
| 217 | RGQGTLVTVSS | BCMA-13 VH FR4 (aa) |
| 218 | RGPGTLVTVSS | BCMA-14 VH FR4 (aa) |

-continued

| SEQ ID NO | SEQUENCE | Description |
|---|---|---|
| 219 | WGQGTLVNVSS | BCMA-17, -33 VH FR4 (aa) |
| 220 | WGQGTTVTVSS | BCMA-19 VH FR4 (aa) |
| 221 | QAVLTQPPSASGTPGQRVTISC | BCMA-13, -14 VL FR1 (aa) |
| 222 | QSVLTQPPSASGTPGQRVTISC | BCMA-15, -18, -21 VL FR1 (aa) |
| 223 | QSALTQPPSASGTPGQRVTISC | BCMA-16 VL FR1 (aa) |
| 224 | QPVLTQPPSVSVAPGKTAMITC | BCMA-17, -33 VL FR1 (aa) |
| 225 | QAVLTQPASVSGSPGQSITISC | BCMA-19 VL FR1 (aa) |
| 226 | QPVLTQPPSASGTPGQRVTISC | BCMA-20, -27 VL FR1 (aa) |
| 227 | QSALTQPASVSGSPGQSITISC | BCMA-22, -23, -40 VL FR1 (aa) |
| 228 | WYQQIPGTAPKLLIY | BCMA-13, -14, -15, -16, -18, -21 VL FR2 (aa) |
| 229 | WYQQKTGQAPVLVVY | BCMA-17, -33 VL FR2 (aa) |
| 230 | WYQQHPGKDPKLMIF | BCMA-19 VL FR2 (aa) |
| 231 | WFRQVPGTAPQLLIY | BCMA-20, -27 VL FR2 (aa) |
| 232 | WYQQPPGKAPKLIIY | BCMA-22, -23, -40 VL FR2 (aa) |
| 233 | GVPDRFSASKSGTSASLAISGLRSEDEADYYC | BCMA-13 VL FR3 (aa) |
| 234 | GVPDRFSGSKSGASASLAISGLQSEDEADYYC | BCMA-14 VL FR3 (aa) |
| 235 | GVPDRFSGSKSGTSASLVISGLRSEDEADYYC | BCMA-15 VL FR3 (aa) |
| 236 | GVPDRFSGSKSGTSASLAISGLQSEDEADYYC | BCMA-16 VL FR3 (aa) |
| 237 | GIPERFSGSNSGNTATLTISRVEAGDEADYYC | BCMA-17, -33 VL FR3 (aa) |
| 238 | GVPDRFSGSKSGTSASLAISGLRSEDEADYYC | BCMA-18 VL FR3 (aa) |
| 239 | GVSDRFSGSKSGNTASLDISGLQPEDEADYYC | BCMA-19 VL FR3 (aa) |
| 240 | GVPDRFSGSKSGSSASLDISGLQSEDEAYYYC | BCMA-20, -27 VL FR3 (aa) |
| 241 | GVPDRFSGSKSGISASLAISGLRSEDEADYYC | BCMA-21 VL FR3 (aa) |
| 242 | GVSNRFSGSKSGNTATLTISGLQGDDEADYYC | BCMA-22, -23, -40 VL FR3 (aa) |
| 243 | FGGGTKVTVL | BCMA-13 VL FR4 (aa) |
| 244 | IGTGTKVTVL | BCMA-19 VL FR4 (aa) |
| 245 | FGGETKLTVL | BCMA-20, -27 VL FR4 (aa) |
| 246 | FGTGTKVTVL | BCMA-21, -22, -23 VL FR4 (aa) |

-continued

| SEQ ID NO | SEQUENCE | Description |
|---|---|---|
| 247 | QMQLVQYGGGVVQPGRSLRLSCAASGFTFSSYAMHWVRQAPGKGLEWVAVISYDGSNKYYAD SVKGRFTISRDNSKNTLYLQMNSLKAEDTAVYYCATLPGRDGYPGAFDYRGQGTLVTVSS | BCMA-13 $V_H$ Chain (aa) |
| 248 | EVQLLESGGGVVQPGRSLRLSCAASGFTFSSYGMHWVRQAPGKGLEWVAVISYDGSNKYYAD SVKGRFTISRDNSKNTLYLQMNSLRAEDTAVYYCATLPGRDGYPGAFDYRGPGTLVTVSS | BCMA-14 $V_H$ Chain (aa) |
| 249 | QVQLLESGGGLVKPGGSLRLSCAASGFTFSSYGMHWVRQAPGKGLEWVAVISYDGSNKYYAD SVKGRFTISRDNSKNTLYLQMNSLRAEDTAVYYCAKDQYSSSAQRADFDYWGQGTLVTVSS | BCMA-15 $V_H$ Chain (aa) |
| 250 | EVQLVQSGPEVKKPGTSVKVSCKASGFTFTSSAMQWVRQARGQRLEWIGWIVVGSGNTNYAQ KFQERVTITRDMSTSTAYMELSSLRSEDTAVYYCAAAPYYDILTGYYLWGQGTLVTVSS | BCMA-16 $V_H$ Chain (aa) |
| 251 | QVQLVQSGGGLVKPGGSLRLSCAASGFTFSDYYMSWIRLAPGKGLEWVSYISSSGSTIYYAD SVKGRFTISRDNAKNSLYLQMNSLRAEDTAVYYCAREADSSADYWGQGTLVNVSS | BCMA-17 $V_H$ Chain (aa) |
| 252 | EVQLLESGGGLVQPGGSLRLSCAASGFTFSSYWMSWHRQAPGKGPEWVAHINQDGSEKYYVD SVKGRFTISRDNAESSLYLQMNSLRAEDTAVYYCARWLAVTNWGQGTLVTVSS | BCMA-18 $V_H$ Chain (aa) |
| 253 | QVQLVQSGAEVKKPGASVKVSCKASGYTFTSYYMHWVRQAPGQGLEWMGWINPNSGGTNYAQ KFQGRVTMTRDTSISTAYMELSRLRSDDTAVYYCARDGGDVWGQGTTVTVSS | BCMA-19 $V_H$ Chain (aa) |
| 254 | EVQLLESGGGLVQPGRSLRLSCAASGFTFDDYAMHWVRQAPGKGLEWVSGISWNSGSIGYAD SVKGRFTISRDNAKNSLYLQMNSLRAEDTALYYCAKGGLGITPYYFDYWGQGTLVTVSS | BCMA-20 $V_H$ Chain (aa) |
| 255 | EVQLVESGGGLVKPGGSLKLSCAASGFTFSDYYMSWIRQAPGKGLEWVSYISSSGSTIYYAD SVKGRFTISRDNAKNSLYLQMNSLRAEDTAVYYCAKVDGGYTEDYWGQGTLVTVSS | BCMA-21 $V_H$ Chain (aa) |
| 256 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGDYTEDYWGQGTLVTVSS | BCMA-22,-23,-40 $V_H$ Chain (aa) |
| 257 | QAVLTQPPSASGTPGQRVTISCSGSGSNIGSNDVSWYQQIPGTAPKLLIYWNDQRPSGVPDR FSASKSGTSASLAISGLRSEDEADYYCAAWDDSLGGSWVFGGGTKVTVL | BCMA-13 $V_L$ Chain (aa) |
| 258 | QAVLTQPPSASGTPGQRVTISCSGSGSNIGSNDVSWYQQIPGTAPKLLIYWNDQRPSGVPDR FSGSKSGASASLAISGLQSEDEADYYCAAWDDRLNGFWVFGGGTKLTVL | BCMA-14 $V_L$ Chain (aa) |
| 259 | QSVLTQPPSASGTPGQRVTISCSGSGSNIGSNDVSWYQQIPGTAPKLLIYWNDQRPSGVPDR FSGSKSGTSASLVISGLRSEDEADYYCAAWDDSLSGWVFGGGTKLTVL | BCMA-15 $V_L$ Chain (aa) |
| 260 | QSALTQPPSASGTPGQRVTISCSGSGSNIGSNDVSWYQQIPGTAPKLLIYWNDQRPSGVPDR FSGSKSGTSASLAISGLQSEDEADYYCASWDDSLSGWVFGGGTKLTVL | BCMA-16 $V_L$ Chain (aa) |
| 261 | QPVLTQPPSVSVAPGKTAMITCGGNNIGFKGVQWYQQKTGQAPVLVVYDDSDRPSGIPERFS GSNSGNTATLTISRVEAGDEADYYCQVWDSASDHWVFGGGTKLTVL | BCMA-17, -33 $V_L$ Chain (aa) |
| 262 | QSVLTQPPSASGTPGQRVTISCSGSGSNIGSNDVSWYQQIPGTAPKLLIYWNDQRPSGVPDR FSGSKSGTSASLAISGLRSEDEADYYCAAWDDSLNGWVFGGGTKLTVL | BCMA-18 $V_L$ Chain (aa) |
| 263 | QAVLTQPASVSGSPGQSITISCTGTSSDVGDYNYVAWYQQHPGKDPKLMIFEVINRPSGVSD RFSGSKSGNTASLDISGLQPEDEADYYCISYSRGSTPYVIGTGTKVTVL | BCMA-19 $V_L$ Chain (aa) |
| 264 | QPVLTQPPSASGTPGQRVTISCSGGKTVNWFRQVPGTAPQLLIYSNDQRPSGVPDRFSGSKS GSSASLDISGLQSEDEAYYYCGSWDDSLNAWVFGGETKLTVL | BCMA-20, -27 $V_L$ Chain (aa) |
| 265 | QSVLTQPPSASGTPGQRVTISCSGSGSNIGSNDVSWYQQIPGTAPKLLIYWNDQRPSGVPDR FSGSKSGISASLAISGLRSEDEADYYCAAWDDSLNGYVFGTGTKVTVL | BCMA-21 $V_L$ Chain (aa) |
| 266 | QSALTQPASVSGSPGQSITISCTGSSSDVGKYNLVSWYQQPPGKAPKLIIYDVNKRPSGVSN RFSGSKSGNTATLTISGLQGDDEADYYCCSYGGSRSYVFGTGTKVTVL | BCMA-22 $V_L$ Chain (aa) |
| 267 | QSALTQPASVSGSPGQSITISCTGSSSDVGKYNLVSWYQQPPGKAPKLIIYDVNKRPSGVSN RFSGSKSGNTATLTISGLQGDDEADYYCSSYGGSRSYVFGTGTKVTVL | BCMA-23 $V_L$ Chain (aa) |
| 268 | QMQLVQYGGGVVQPGRSLRLSCAASGFTFSSYAMHWVRQAPGKGLEWVAVISYDGSNKYYAD SVKGRFTISRDNSKNTLYLQMNSLKAEDTAVYYCATLPGRDGYPGAFDYRGQGTLVTVSSGG GGSGGGGSGGGGSQAVLTQPPSASGTPGQRVTISCSGSGSNIGSNDVSWYQQIPGTAPKLLI YWNDQRPSGVPDRFSASKSGTSASLAISGLRSEDEADYYCAAWDDSLGGSWVFGGGTKVTVL | BCMA-13 scFv (aa) |
| 269 | EVQLLESGGGVVQPGRSLRLSCAASGFTFSSYGMHWVRQAPGKGLEWVAVISYDGSNKYYAD SVKGRFTISRDNSKNTLYLQMNSLRAEDTAVYYCATLPGRDGYPGAFDYRGPGTLVTVSSGG GGSGGGGSGGGGSQAVLTQPPSASGTPGQRVTISCSGSGSNIGSNDVSWYQQIPGTAPKLLI YWNDQRPSGVPDRFSGSKSGASASLAISGLQSEDEADYYCAAWDDRLNGFWVFGGGTKLTVL | BCMA-14 scFv (aa) |

| SEQ ID NO | SEQUENCE | Description |
|---|---|---|
| 270 | QVQLLESGGGLVKPGGSLRLSCAASGFTFSSYGMHWVRQAPGKGLEWVAVISYDGSNKYYAD SVKGRFTISRDNSKNTLYLQMNSLRAEDTAVYYCAKDQYSSSAQRADFDYWGQGTLVTVSSG GGGSGGGGSGGGGSQSVLTQPPSASGTPGQRVTISCSGSGSNIGSNDVSWYQQIPGTAPKLL IYWNDQRPSGVPDRFSGSKSGTSASLVISGLRSEDEADYYCAAWDDSLSGWVFGGGTKLTVL | BCMA-15 scFv (aa) |
| 271 | EVQLVQSGPEVKKPGTSVKVSCKASGFTFTSSAMQWVRQARGQRLEWIGWIVVGSGNTNYAQ KFQERVTITRDMSTSTAYMELSSLRSEDTAVYYCAAAPYYDILTGYYLWGQGTLVTVSSGGG GSGGGGSGGGGSQSALTQPPSASGTPGQRVTISCSGSGSNIGSNDVSWYQQIPGTAPKLLIY WNDQRPSGVPDRFSGSKSGTSASLAISGLQSEDEADYYCASWDDSLSGWVFGGGTKLTVL | BCMA-16 scFv (aa) |
| 272 | QVQLVQSGGGLVKPGGSLRLSCAASGFTFSDYYMSWIRLAPGKGLEWVSYISSSGSTIYYAD SVKGRFTISRDNAKNSLYLQMNSLRAEDTAVYYCAREADSSADYWGQGTLVNVSSGGGGSGG GGSGGGGSQPVLTQPPSVSVAPGKTAMITCGGNNIGFKGVQWYQQKTGQAPVLVVYDDSDRP SGIPERFSGSNSGNTATLTISRVEAGDEADYYCQVWDSASDHWVFGGGTKLTVL | BCMA-17 scFv (aa) |
| 273 | EVQLLESGGGLVQPGGSLRLSCAASGFTFSSYWMSWHRQAPGKGPEWVAHINQDGSEKYYVD SVKGRFTISRDNAESSLYLQMNSLRAEDTAVYYCARWLAVTNWGQGTLVTVSSGGGGSGGGG SGGGGSQSVLTQPPSASGTPGQRVTISCSGSGSNIGSNDVSWYQQIPGTAPKLLIYWNDQRP SGVPDRFSGSKSGTSASLAISGLRSEDEADYYCAAWDDSLNGWVFGGGTKLTVL | BCMA-18 scFv (aa) |
| 274 | QVQLVQSGAEVKKPGASVKVSCKASGYTFTSYYMHWVRQAPGQGLEWMGWINPNSGGTNYAQ KFQGRVTMTRDTSISTAYMELSRLRSDDTAVYYCARDGGDVWGQGTTVTVSSGGGGSGGGGS GGGGSQAVLTQPASVSGSPGQSITISCTGTSSDVGDYNYVAWYQQHPGKDPKLMIFEVINRP SGVSDRFSGSKSGNTASLDISGLQPEDEADYYCISYSRGSTPYVIGTGTKVTVL | BCMA-19 scFv (aa) |
| 275 | EVQLLESGGGLVQPGRSLRLSCAASGFTFDDYAMHWVRQAPGKGLEWVSGISWNSGSIGYAD SVKGRFTISRDNAKNSLYLQMNSLRAEDTALYYCAKGGLGITPYYFDYWGQGTLVTVSSGGG GSGGGGSGGGGSQPVLTQPPSASGTPGQRVTISCSGGKTVNWFRQVPGTAPQLLIYSNDQRP SGVPDRFSGSKSGSSASLDISGLQSEDEAYYCGSWDDSLNAWVFGGETKLTVL | BCMA-20 scFv (aa) |
| 276 | EVQLVESGGGLVKPGGSLKLSCAASGFTFSDYYMSWIRQAPGKGLEWVSYISSSGSTIYYAD SVKGRFTISRDNAKNSLYLQMNSLRAEDTAVYYCAKVDGGYTEDYWGQGTLVTVSSGGGGSG GGGSGGGGSQSVLTQPPSASGTPGQRVTISCSGSGSNIGSNDVSWYQQIPGTAPKLLIYWND QRPSGVPDRFSGSKSGISASLAISGLRSEDEADYYCAAWDDSLNGYVFGTGTKVTVL | BCMA-21 scFv (aa) |
| 277 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGDYTEDYWGQGTLVTVSSGGGGSG GGGSGGGGSQSALTQPASVSGSPGQSITSCTGSSSDVGKYNLVSWYQQPPGKAPKLIIYDV NKRPSGVSNRFSGSKSGNTATLTISGLQGDDEADYYCCSYGGSRSYVFGTGTKVTVL | BCMA-22 scFv (aa) |
| 278 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGDYTEDYWGQGTLVTVSSGGGGSG GGGSGGGGSQSALTQPASVSGSPGQSITISCTGSSSDVGKYNLVSWYQQPGKAPKLIIYDV NKRPSGVSNRFSGSKSGNTATLTISGLQGDDEADYYCSSYGGSRSYVFGTGTKVTVL | BCMA-23 scFv (aa) |
| 279 | VDGDDAFDI | $V_H$-3 CDR-H3 (aa) |
| 280 | DPLSWDSSGKGPR | $V_H$-4 CDR-H3 (aa) |
| 281 | ENYDFWSWRYYYDMDV | $V_H$-5 CDR-H3 (aa) |
| 282 | VDGPPSYDI | $V_H$-6 CDR-H3 (aa) |
| 283 | GDWDDAFDI | $V_H$-7 CDR-H3 (aa) |
| 284 | VDGDYEDY | $V_H$-9 CDR-H3 (aa) |
| 285 | DVPSSGDDAFDI | $V_H$-10 CDR-H3 (aa) |
| 286 | VDGDDVFDI | $V_H$-11 CDR-H3 (aa) |
| 287 | VDGDAFDI | $V_H$-12 CDR-H3 (aa) |
| 288 | DYSIN | BCMA-C1 $V_H$ CDR-H1 (aa) |
| 289 | NFGMN | BCMA-C2 $V_H$ CDR-H1 (aa) |
| 290 | WINTETREPAYAYDFRG | BCMA-C1 $V_H$ CDR-H2 (aa) |
| 291 | WINTYTGESYFADDFKG | BCMA-C2 $V_H$ CDR-H2 (aa) |

| SEQ ID NO | SEQUENCE | Description |
|---|---|---|
| 292 | DYSYAMDY | BCMA-C1 $V_H$ CDR-H3 (aa) |
| 293 | GEIYYGYDGGFAY | BCMA-C2 $V_H$ CDR-H3 (aa) |
| 294 | GYTFTDY | BCMA-C1 $V_H$ CDR-H1 (aa) Chothia numbering |
| 295 | GYTFTNF | BCMA-C2 $V_H$ CDR-H1 (aa) Chothia numbering |
| 296 | NTETRE | BCMA-C1 $V_H$ CDR-H2 (aa) Chothia numbering |
| 297 | NTYTGE | BCMA-C2 $V_H$ CDR-H2 (aa) Chothia numbering |
| 298 | GYTFTDYSIN | BCMA-C1 $V_H$ CDR-H1 (aa) AbM numbering |
| 299 | GYTFTNFGMN | BCMA-C2 $V_H$ CDR-H1 (aa) AbM numbering |
| 300 | WINTETREPA | BCMA-C1 $V_H$ CDR-H2 (aa) AbM numbering |
| 301 | WINTYTGESY | BCMA-C2 $V_H$ CDR-H2 (aa) AbM numbering |
| 302 | RASESVTILGSHLIH | BCMA-C1 VL CDR-L1 (aa) |
| 303 | RASQDVNTAVS | BCMA-C2 VL CDR-L1 (aa) |
| 304 | LASNVQT | BCMA-C1 VL CDR-L2 (aa) |
| 305 | SASYRYT | BCMA-C2 VL CDR-L2 (aa) |
| 306 | LQSRTIPRT | BCMA-C1 VL CDR-L3 (aa) |
| 307 | QQHYSTPWT | BCMA-C2 VL CDR-L3 (aa) |
| 308 | QIQLVQSGPELKKPGETVKISCKASGYTFT | BCMA-C1 $V_H$ FR1 (aa) |
| 309 | QIQLVQSGPDLKKPGETVKLSCKASGYTFT | BCMA-C2 $V_H$ FR1 (aa) |
| 310 | WVKRAPGKGLKWMG | BCMA-C1 $V_H$ FR2 (aa) |
| 311 | WVKQAPGKGFKWMA | BCMA-C2 $V_H$ FR2 (aa) |
| 312 | RFAFSLETSASTAYLQINNLKYEDTATYFCAL | BCMA-C1 $V_H$ FR3 (aa) |
| 313 | RFAFSVETSATTAYLQINNLKTEDTATYFCAR | BCMA-C2 $V_H$ FR3 (aa) |
| 314 | WGQGTSVTVSS | BCMA-C1 $V_H$ FR4 (aa) |
| 315 | WGQGTLVTVSA | BCMA-C2 $V_H$ FR4 (aa) |
| 316 | DIVLTQSPPSLAMSLGKRATISC | BCMA-C1 $V_L$ FR1 (aa) |
| 317 | DVVMTQSHRFMSTSVGDRVSITC | BCMA-C2 $V_L$ FR1 (aa) |
| 318 | WYQQKPGQPPTLLIQ | BCMA-C1 $V_L$ FR2 (aa) |
| 319 | WYQQKPGQSPKLLIF | BCMA-C2 $V_L$ FR2 (aa) |

| SEQ ID NO | SEQUENCE | Description |
|---|---|---|
| 320 | GVPARFSGSGSRTDFTLTIDPVEEDDVAVYYC | BCMA-C1 $V_L$ FR3 (aa) |
| 321 | GVPDRFTGSGSGADFTLTISSVQAEDLAVYYC | BCMA-C2 $V_L$ FR3 (aa) |
| 322 | FGGGTKLEIK | BCMA-C1 $V_L$ FR4 (aa) |
| 323 | FGGGTKLDIK | BCMA-C2 $V_L$ FR4 (aa) |
| 324 | QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS | BCMA-C1 $V_H$ Chain (aa) |
| 325 | QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA | BCMA-C2 $V_H$ Chain (aa) |
| 326 | DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK | BCMA-C1 $V_L$ Chain (aa) |
| 327 | DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK | BCMA-C2 $V_L$ Chain (aa) |
| 328 | DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS | BCMA-C1 VL-VH scFv (aa) |
| 329 | QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK | BCMA-C2 VH-VL scFv (aa) |
| 330 | CAGGTGCAGCTGGTGCAGTCTGGGGGAGGCTTGGTACAGCCAGGGCGGTCCCTGAGACTCTCCTGTACAGCTTCTGGATTCACCTTTGGTGATTATGCTATGAGCTGGTTCCGCCAGGCTCCAGGGAAGGGGCTGGAGTGGGTAGGTTTCATTAGAAGCAAAGCTTATGGTGGGACAACAGAATACGCCGCGTCTGTGAAAGGCAGATTCACCATCTCAAGAGATGATTCCAAAAGCATCGCCTATCTGCAAATGAACAGCCTGAAAACCGAGGACACAGCCGTGTATTACTGTGCGGCCTGGAGTGCCCCGACTGACTACTGGGGCCAGGGAACCCTGGTCACCGTCTCCTCAGGTGGAGGCGGTTCAGGCGGAGGTGGCTCTGGCGGTGGCGGATCGGATATTGTGATGACCCAGTCTCCAGACTCCCTGTCTGTGTCTCCGGGCGAGAGGGCCACCATCAGCTGCAAGTCCAGCCAGAGTGTTTTATCCACCTCCAACAATAAGAACTATTTAGCTTGGTATCAGCAGAAACCAGGACAGCCCCCTAGGCTGCTCCTTTACTGGGCATCTACCCGGGAGGCCGGGGTCCCTGACCGATTCAGTGGCAGCGGGTCTGGGACAGATTTCACTCTCACCATCAGCAGCCTGCAGGCTGAAGATGTGGCCGTTTATTACTGTCAACAATATTTCAGTTCTCCGTACACTTTTGGCCACGGGACCAAGCTGGAAATCAAA | BCMA-1 scFv (nt) |
| 331 | GAGGTGCAGCTGGTGGAGTCTGGGGGAGGCTTGGTCAAGCCTGGAGGGTCCCTGAGACTCTCCTGTGCAGCCTCTGGATTCACCTTCAGTGACTACTACATGAGCTGGATCCGCCAGGCTCCAGGGAAGGGGCTGGAGTGGGTTTCATACATTAGTAGTAGTGGTAGTACCATATACTACGCAGACTCTGTGAAGGGCCGATTCACCATCTCCAGGGACAACGCCAAGAACTCACTGTATCTGCAAATGAACAGCCTGAGAGCCGAGGACACGGCCGTGTATTACTGTGCGAAAGTGGATGGCCCTCCTTCTTCTGATATCTGGGGCCAAGGGACAATGGTCACCGTCTCCTCAGGTGGAGGCGGTTCAGGCGGAGGTGGCTCTGGCGGTGGCGGATCGGAAATAGTGATGACGCAGTCTCCAGCCACCCTGTCTGTGTCTCCAGGGGAAACAGCCACCCTCTCCTGCAGGGCCAGTCAGAGTATTAAGACCAACTTGGCCTGGTACCAGCAGAAACCTGGCCAGGCTCCCAGGCTCCTCATCTATGCTGCATCCACCAGGGCCACTGGCATCCCAGACAGATTCAGTGGCAGTGGGTCTGGGACAGACTTCACTCTCACCATCACCAGACTGGAGCCTGAAGATTTTGCAGTGTATTACTGTCAGCAATATGGTAGCTCACCCACTTTTGGCCGGGGGACCAAGCTGGAAATCAAA | BCMA-2 scFv (nt) |
| 332 | CAGGTGCAGCTGGTGCAGTCTGGGGGAGGCTTGGTACAGCCAGGGCGGTCCCTGAGACTCTCCTGTACAGCTTCTGGATTCACCTTTGGTGATTATGCTATGAGCTGGTTCCGCCAGGCTCCAGGGAAGGGGCTGGAGTGGGTAGGTTTCATTAGAAGCAAAGCTTATGGTGGGACAACAGAATACGCCGCGTCTGTGAAAGGCAGATTCACCATCTCAAGAGATGATTCCAAAAGCATCGCCTATCTGCAAATGAACAGCCTGAAAACCGAGGACACAGCCGTGTATTACTGTGCGGCCTGGAGTGCCCCGACTGACTACTGGGGCCAGGGAACCCTGGTCACCGTCTCCTCAGGTGGAGGCGGTTCAGGCGGAGGTGGCTCTGGCGGTGGCGGATCGGATATTGTGATGACCCAGTCTCCAGACTCCCTGGTTGTGTCTCTGGGCGAGAGGGCCACCATCAACTGCAAGTCCAGCCAGAGTGTTTTACACAGCTCCAACAATAAGAATTACTTAGCTTGGTACCAGCAGAAACCAGGACAGCCTCCTAAGCTGCTCATTTACTGGGCATCTACCCGGGAATCCGGGGTCCCTGACCGGTTCAGTGGCAGCGGGTCTGGGACAGATTTCACTCTCACCATCAGCAGCCTGCAGGCTGAAGATGTGGCAGTTTATTACTGTCAGCAGTATTATACTACTCCGCTCACTTTCGGCGGAGGGACCAAGGTGGAAATCAAA | BCMA-3 scFv (nt) |
| 333 | CAGGTGCAGCTGGTGCAGTCTGGGGGAGGCTTGGTACAGCCAGGGCGGTCCCTGAGACTCTCCTGTACAGCTTCTGGATTCACCTTTGGTGATTATGCTATGAGCTGGTTCCGCCAGGCTCCAGGGAAGGGGCTGGAGTGGGTAGGTTTCATTAGAAGCAAAGCTTATGGTGGGACAACAGAATACGCCGCGTCTGTGAAAGGCAGATTCACCATCTCAAGAGATGATTCCAAAAGCATCGCCTATCT | BCMA-4 scFv (nt) |

| SEQ ID NO | SEQUENCE | Description |
|---|---|---|
| | GCAAATGAACAGCCTGAAAACCGAGGACACAGCCGTGTATTACTGTGCGGCCTGGAGTGCCC<br>CGACTGACTACTGGGGCCAGGGAACCCTGGTCACCGTCTCCTCAGGTGGAGGCGGTTCAGGC<br>GGAGGTGGCTCTGGCGGTGGCGGATCGGCCATCCGGATGACCCAGTCTCCATCCTCCCTGTC<br>CGCGTCTCTGGGGGACAGAGTCACCATCACTTGCCGGGCGAGTCAGGACATTAGGAATTCTT<br>TGGCCTGGTATCAGCAGAGGCCAGGGAAAGCCCCTAAACTCCTGCTTTCTGCTGCATCCAGA<br>TTGGAAAGTGGGGTCCCTTCTAGGTTCAGTGGCACTACTTCTGGGGCGGAGTATGCTCTCAG<br>CATCAGCAGCCTGCAGCCTGAAGATGTCGCATCTTATTTCTGTCAGCAGTATTATAGTCTCC<br>CTCTCTCCTTCGGCGGAGGGACCAAGGTGGAAATCAAA | |
| 334 | CAGGTGCAGCTGGTGCAGTCTGGGGGAGGCTTGGTACAGCCAGGGCGGTCCCTGAGACTCTC<br>CTGTACAGCTTCTGGATTCACCTTTGGTGATTATGCTATGAGCTGGTTCCGCCAGGCTCCAG<br>GGAAGGGGCTGGAGTGGGTAGGTTTCATTAGAAGCAAAGCTTATGGTGGGACAACAGAATAC<br>GCCGCGTCTGTGAAAGGCAGATTCACCATCTCAAGAGATGATTCCAAAAGCATCGCCTATCT<br>GCAAATGAACAGCCTGAAAACCGAGGACACAGCCGTGTATTACTGTGCGGCCTGGAGTGCCC<br>CGACTGACTACTGGGGCCAGGGAACCCTGGTCACCGTCTCCTCAGGTGGAGGCGGTTCAGGC<br>GGAGGTGGCTCTGGCGGTGGCGGATCGGACATCGTGATGACCCAGTCTCCAGACTCCCTGGC<br>TGTGTCTCTGGGCGAGAGGGCCACCATCAACTGCAAGTCCAGCCAGAGTGTTTTATACAGCT<br>CCAACAATAAGAACTACTTAGCTTGGTACCAGCAGAAACCAGGACAGCCTCCTAAGCTGCTC<br>ATTTACTGGGCATCTACCCGGGAATCCGGGTCCCTGACCGATTCAGTGGCAGCGGGTCTGG<br>GACAGATTTCACTCTCACCATCAGCAGCCTGCAGGCTGAAGATGTGGCAGTTTATTACTGTC<br>AGCAATATTATAGTACTCCGTGGACGTTCGGCCAAGGGACCAAGGTGGATATCAAA | BCMA-5 scFv (nt) |
| 335 | CAGGTGCAGCTGGTGCAGTCTGGGGGAGGCTTGGTACAGCCAGGGCGGTCCCTGAGACTCTC<br>CTGTACAGCTTCTGGATTCACCTTTGGTGATTATGCTATGAGCTGGTTCCGCCAGGCTCCAG<br>GGAAGGGGCTGGAGTGGGTAGGTTTCATTAGAAGCAAAGCTTATGGTGGGACAACAGAATAC<br>GCCGCGTCTGTGAAAGGCAGATTCACCATCTCAAGAGATGATTCCAAAAGCATCGCCTATCT<br>GCAAATGAACAGCCTGAAAACCGAGGACACAGCCGTGTATTACTGTGCGGCCTGGAGTGCCC<br>CGACTGACTACTGGGGCCAGGGAACCCTGGTCACCGTCTCCTCAGGTGGAGGCGGTTCAGGC<br>GGAGGTGGCTCTGGCGGTGGCGGATCGGATATTGTGATGACCCAGTCTCCATCGTCCCTGTC<br>TGTGTCTGTAGGAGAGAGTCACCATCACTTGTCGGGCGAGTCAGTCTATAAGTAATTCCT<br>TAGCCTGGTATAAACAGAGACCGGGAGAAGCCCCTAAACTCCTGATACATGCTGCATCCAAT<br>GTGGAAGATGGGGTCCCTTCGAGGTTCAGCGGCAGGGATCTGGGACAGTTTTCACTCTCGC<br>CATCAGCAATGTACAGCCTGAAGATTTCGCAACTTACTACTGTCAGCAGAGTCACATGTACC<br>CTCCGACTTTCGGCGGGGGACCAAGGTGGAAATCAAA | BCMA-6 scFv (nt) |
| 336 | CAGGTGCAGCTGGTGCAGTCTGGGGGAGGCTTGGTACAGCCAGGGCGGTCCCTGAGACTCTC<br>CTGTACAGCTTCTGGATTCACCTTTGGTGATTATGCTATGAGCTGGTTCCGCCAGGCTCCAG<br>GGAAGGGGCTGGAGTGGGTAGGTTTCATTAGAAGCAAAGCTTATGGTGGGACAACAGAATAC<br>GCCGCGTCTGTGAAAGGCAGATTCACCATCTCAAGAGATGATTCCAAAAGCATCGCCTATCT<br>GCAAATGAACAGCCTGAAAACCGAGGACACAGCCGTGTATTACTGTGCGGCCTGGAGTGCCC<br>CGACTGACTACTGGGGCCAGGGAACCCTGGTCACCGTCTCCTCAGGTGGAGGCGGTTCAGGC<br>GGAGGTGGCTCTGGCGGTGGCGGATCGGTCATCCAGTTGACCCAGTCTCCCTCCTCACTGTC<br>TGCATCTGTAGGGGACAGAGTCACCATCACTTGTCGGGCGAGTCAGGACATTGGCGATTATT<br>TAGCCTGGTTTCAGCAGAGACCAGGGAAAGCCCCTAAGTCCCTGATCTATGTTGCGTCCACT<br>TTGCAGAGTGGGGTCCCATCAAGGTTCAGCGGCAGTGGATCTGGGACACACTTCACTCTCAC<br>CATCAACAGCCTGCAGCCTGAAGATTTTGCAACTTATTACTGCCAACAGTATCATAGTCACC<br>CGTGGACGTTCGGCCCAGGGACCAAGGTGGATATCAAA | BCMA-7 scFv (nt) |
| 337 | CAGGTCCAGCTGGTGCAGTCTGGGGGAGGCTTGGTACAGCCAGGGCGGTCCCTGAGACTCTC<br>CTGTACAGCTTCTGGATTCACCTTTGGTGATTATGCTATGAGCTGGTTCCGCCAGGCTCCAG<br>GGAAGGGGCTGGAGTGGGTAGGTTTCATTAGAAGCAAAGCTTATGGTGGGACAACAGAATAC<br>GCCGCGTCTGTGAAAGGCAGATTCACCATCTCAAGAGATGATTCCAAAAGCATCGCCTATCT<br>GCAAATGAACAGCCTGAAAACCGAGGACACAGCCGTGTATTACTGTGCGGCCTGGAGTGCCC<br>CGACTGACTACTGGGGCCAGGGAACCCTGGTCACCGTCTCCTCAGGTGGAGGCGGTTCAGGC<br>GGAGGTGGCTCTGGCGGTGGCGGATCGGATATTGTGATGACCCAGTCTCCAGACTCCCTGGC<br>TGTGTCTCTGGGCGAGAGGGCCACCATCAACTGCAAGTCCAGCCAGAGTGTTTTATACAGCT<br>CCAACAATAAGAACTACTTAGCTTGGTACCAGCAGAAACCAGGACAGCCTCCTAAGCTGCTC<br>ATTTACTGGGCATCTACCCGGGAATCCGGGGTCCCTGACCGATTCAGTGGCAGCGGGTCTGG<br>GACAGATTTCACTCTCACCATCAGCAGCCTGCAGGCTGAAGATGTGGCAGTTTATTACTGTC<br>AGCAATATTATAGTACTCCGTACACTTTTGGCCAGGGGACCAAGCTGGAAATCAAA | BCMA-8 scFv (nt) |
| 338 | GAAGTGCAGCTGGTGCAGTCTGGGGGAGGCTTGGTCAAGCCTGGAGGGTCCCTGAGACTCTC<br>CTGTGCAGCCTCTGGATTCACCTTCAGTGACTACTACATGAGCTGGATCCGCCAGGCTCCAG<br>GGAAGGGGCTGGAGTGGGTTTCATACATTAGTAGTAGTGGTAGTACCATATACTACGCAGAC<br>TCTGTGAAGGGCCGATTCACCATCTCCAGGGACAACGCCAAGAACTCACTGTATCTGCAAAT<br>GAACAGCCTGAGAGCCGAGGACACGGCCGTGTATTACTGTGCGAGAGTGGACGGTGACTACG<br>TCGATGACTACTGGGGCCAGGGAACCCTGGTCACCGTCTCCTCAGGTGGAGGCGGTTCAGGC<br>GGAGGTGGCTCTGGCGGTGGCGGATCGTCCTATGAGCTGACTCAGCCGCCCTCGGTGTCTGT<br>GGCCCCAGGACAGACGGCCAGGGTTACCTGTGGGCAAATAATATTGGAAGCAAAAGTGTCC<br>ACTGGTACCAGCAGAAGCCAGGCCAGGCCCCCATGCTGGTCGTCTATGATGATGACGACCGG<br>CCCTCCGGGATCCCTGAGCGATTCTCTGGCTCCAACTCTGGGAACACGGCCACCCTGACCAT<br>CAGCGGGGTCGAGGCCGGGGATGAGGCCGACTACTTCTGTCACGTGTGGGATAGAAGTCGTG<br>ATCATTATGTCTTCGGAACTGGGACCAAGCTGACCGTCCTA | BCMA-9 scFv (nt) |

| SEQ ID NO | SEQUENCE | Description |
|---|---|---|
| 339 | GAAGTGCAGCTGGTGCAGTCTGGGGGAGGCTTGGTCAAGCCTGGAGGGTCCCTGAGACTCTC<br>CTGTGCAGCCTCTGGATTCACCTTCAGTGACTACTACATGAGCTGGATCCGCCAGGCTCCAG<br>GGAAGGGGCTGGAGTGGGTTTCATACATTAGTAGTAGTGGTAGTACCATATACTACGCAGAC<br>TCTGTGAAGGGCCGATTCACCATCTCCAGGGACAACGCCAAGAACTCACTGTATCTGCAAAT<br>GAACAGCCTGAGAGCCGAGGACACGGCCGTGTATTACTGTGCGAGAGTGGACGGTGACTACG<br>TCGATGACTACTGGGGCCAGGGAACCCTGGTCACCGTCTCCTCAGGTGGAGGCGGTTCAGGC<br>GGAGGTGGCTCTGGCGGTGCGGATCGTCCTATGAGCTGACTCAGCCGCCCTCGGTGTCTGT<br>GGCCCCAGGACAGACGGCCAGGGTTACCTGTGGGGCAAATAATATTGGAAGCAAAAGTGTCC<br>ACTGGTACCAGCAGAAGCCAGGCCAGGCCCCATGCTGGTCGTCTATGATGATGACGACCGG<br>CCCTCCGGGATCCCTGAGCGATTCTCTGGCTCCAACTCTGGGAACACGGCCACCCTGACCAT<br>CAGCGGGGTCGAGGCCGGGGATGAGGCCGACTACTTCTGTCACGTGTGGGATAGAAGTCGTG<br>ATCATTATGTCTTCGGAACTGGGACCAAGCTGACCGTCCTA | BCMA-10 scFv (nt) |
| 340 | CAGGTGCAGCTGGTACAGTCTGGGGGAGGCTTGGTACAGCCTGGCAGGTCCCTGAGACTCTC<br>CTGTGCAGCCTCTGGATTCACCTTTGATGATTATGCCATGCACTGGGTCCGGCAGGCTCCAG<br>GGAAGGGCCTGGAGTGGGTCTCAGGTATTAGTTGGAATAGTGGTAGCATAGGCTATGCGGAC<br>TCTGTGAAGGGCCGATTCACCATCTCCAGAGACAACGCCAAGAACTCCCTGTATCTGCAAAT<br>GAACAGTCTGAGAGCTGAGGACACGGCCGTGTATTACTGTGCGAGAGATCTGGGGCCCGACT<br>ACGATCCCGATGCTTTTGATATCTGGGGCCAAGGGACAATGGTCACCGTTTCCTCAGGTGGA<br>GGCGGTTCAGGCGGAGGTGGCTCTGGCGGTGCGGATCGCAGCTTGTGCTGACTCAGCCACC<br>CTCAGCGTCTGGGACCCCCGGGCAGAGGGTCACCATCTCTTGTTCTGGAAGCAGCTCCAACA<br>TCGGAAGTAATGCTGTAAACTGGTACCAGCAGCTCCCAGGAACGGCCCCCGAAGTCCTCATC<br>TATAATAGTCATCAGCGGCCCTCAGGGGTCCCTGACCGATTCTCTGGCTCCAAGTCTGGCAC<br>CTCAGCCTCCCTGGCCATCAATGGGCTCCAGTCTGAGGACGAGGCTGATTATTACTGTGCAG<br>CATGGGATGACAGCCTGAGAGGTTACGTCTTCGGAACTGGGACCAAGCTCACCGTCCTA | BCMA-11 scFv (nt) |
| 341 | GAGGTGCAGCTGGTGGAGTCTGGGGGAGGCTTGGTCAAGCCTGGAGGGTCCCTGAGACTCTC<br>CTGTGCAGCCTCTGGATTCACCTTCAGTGACTACTACATGAGCTGGATCCGCCAGGCTCCAG<br>GGAAGGGGCTGGAGTGGGTTTCATACATTAGTAGTAGTGGTAGTACCATATACTACGCAGAC<br>TCTGTGAAGGGCCGATTCACCATCTCCAGGGACAACGCCAAGAACTCACTGTATCTGCAAAT<br>GAACAGCCTGAGAGCCGAGGACACGGCCGTGTATTACTGTGCGAAAGTGGATGGCCCTCTT<br>CTTTTGATATCTGGGGCCAAGGGACAATGGTCACCGTCTCCTCAGGTGGAGGCGGTTCAGGC<br>GGAGGTGGCTCTGGCGGTGCGGATCGCAGTCTGCCCTGACGCAGCCGCCCTCAGTGTCTGC<br>GGCCCCAGGACAGAAGGTCACCATCTCCTGCTCTGGAAGCCGCTCCAACATTGGGAATAATT<br>ATGTATCCTGGTACCAACAGCTCCCAGGAACAGCCCCCAAACTCCTCATTTATGACAATGCT<br>AAGCGACCCTCAGGAATTCCTGACCGATTCTCTGGCTCCAAGTCTGGCACGTCAGCCACCCT<br>GGACATCGCCGGACTCCAGACTGGGGATGAGGCCGACTATTACTGTCAGGTGTGGGATAGTA<br>GTAGTGATCATTGGGTATTCGGCGGAGGGACCAAGCTCACCGTCCTA | BCMA-12 scFv (nt) |
| 342 | CAGATGCAGCTGGTGCAGTATGGGGGAGGCGTGGTCCAGCCTGGGAGGTCCCTGAGACTCTC<br>CTGTGCAGCCTCTGGATTCACCTTCAGTAGCTATGCTATGCACTGGGTCCGCCAGGCTCCAG<br>GCAAGGGGCTGGAGTGGGTGGCAGTTATATCATATGATGGAAGTAATAAATACTACGCAGAC<br>TCCGTGAAGGGCCGATTCACCATCTCCAGAGACAATTCCAAGAACACGCTGTATCTGCAAAT<br>GAACAGCCTGAAAGCTGAGGACACGGCTGTGTATTACTGTGCTACCCTACCCGGTAGAGATG<br>GCTACCCCGGAGCCTTTGACTACAGGGGCCAGGGAACCCTGGTCACCGTCTCCTCAGGTGGA<br>GGCGGTTCAGGCGGAGGTGGCTCTGGCGGTGCGGATCGCAGGCTGTGCTGACTCAGCCACC<br>CTCAGCGTCTGGGACCCCCGGGCAGAGGGTCACCATCTCTTGTTCTGGAAGCGGCTCCAACA<br>TCGGAAGTAATGATGTCTCCTGGTATCAGCAGATCCCAGGAACGGCCCCCAAACTCCTCATC<br>TACTGGAATGATCAGCGGCCCTCAGGGGTCCCTGACCGATTCTCTGCCTCCAAGTCTGGCAC<br>CTCAGCCTCCCTGGCCATCAGTGGGCTCCGGTCCGAGGATGAGGCTGATTATTACTGTGCAG<br>CATGGGATGACAGCCTGGGTGGTTCTTGGGTGTTCGGCGGAGGGACCAAGGTCACCGTCCTA | BCMA-13 scFv (nt) |
| 343 | GAGGTGCAGCTGTTGGAGTCTGGGGGAGGCGTGGTCCAGCCTGGGAGGTCCCTGAGACTCTC<br>CTGTGCAGCGTCTGGATTCACCTTCAGTAGCTATGGCATGCACTGGGTCCGCCAGGCTCCAG<br>GCAAGGGGCTGGAGTGGGTGGCAGTTATATCATATGATGGAAGTAATAAATACTACGCAGAC<br>TCCGTGAAGGGCCGATTCACCATCTCCAGAGACAATTCCAAGAACACGCTGTATCTGCAAAT<br>GAACAGCCTGAGAGCTGAGGACACGGCTGTGTATTACTGTGCTACCTACCCGGTAGAGATG<br>GCTACCCCGGAGCCTTTGACTACAGGGGCCCGGGAACCCTGGTCACCGTCTCCTCAGGTGGA<br>GGCGGTTCAGGCGGAGGTGGCTCTGGCGGTGCGGATCGCAGGCTGTGCTGACTCAGCCACC<br>CTCAGCGTCTGGGACCCCCGGGCAGAGGGTCACCATCTCTTGTTCTGGAAGCGGCTCCAACA<br>TCGGAAGTAATGATGTCTCCTGGTATCAGCAGATCCCAGGAACGGCCCCCAAACTCCTCATC<br>TACTGGAATGATCAGCGGCCCTCAGGGGTCCCTGACCGATTCTCTGGCTCCAAGTCTGGCGC<br>CTCAGCCTCTCTGGCCATCAGTGGGCTCCAGTCTGAGGATGAGGCTGATTATTATTGTGCAG<br>CATGGGATGACAGGTTGAACGGTTTTTGGGTGTTCGGCGGAGGGACCAAGCTCACCGTCCTA | BCMA-14 scFv (nt) |
| 344 | CAGGTGCAGCTGTTGGAGTCTGGGGGAGGCCTGGTCAAGCCTGGGGGGTCCCTGAGACTCTC<br>CTGTGCAGCCTCTGGATTCACCTTCAGTAGCTATGGCATGCACTGGGTCCGCCAGGCTCCAG<br>GCAAGGGGCTGGAGTGGGTGGCAGTTATATCATATGATGGAAGTAATAAATACTATGCAGAC<br>TCCGTGAAGGGCCGATTCACCATCTCCAGAGACAATTCCAAGAACACGCTGTATCTGCAAAT<br>GAACAGCCTGAGAGCTGAGGACACGGCTGTGTATTACTGTGCGAAAGATCAGTATAGCAGTA<br>GCGCACAAAGGGCCGACTTTGACTACTGGGGCCAGGGAACCCTGGTCACCGTCTCCTCAGGT<br>GGAGGCGGTTCAGGCGGAGGTGGTTCTGGCGGTGGCGGATCGCAGTCTGTGCTGACGCAGCC | BCMA-15 scFv (nt) |

| SEQ ID NO | SEQUENCE | Description |
|---|---|---|
| | ACCCTCAGCGTCTGGGACCCCGGGCAGAGGGTCACCATCTCTTGTTCTGGAAGCGGCTCCA<br>ACATCGGAAGTAATGATGTCTCCTGGTATCAGCAGATCCCAGGAACGGCCCCCAAACTCCTC<br>ATCTACTGGAATGATCAGCGGCCCTCAGGGGTCCCTGACCGGTTCTCAGGCTCCAAGTCTGG<br>CACCTCAGCCTCCCTGGTCATCAGTGGGCTCCGGTCCGAGGATGAGGCTGATTATTACTGTG<br>CAGCATGGGATGACAGCCTGAGTGGTTGGGTGTTCGGCGGAGGGACCAAGCTGACCGTCCTA | |
| 345 | GAGGTCCAGCTGGTACAGTCTGGGCCTGAGGTGAAGAAGCCTGGGACCTCAGTGAAGGTCTC<br>CTGCAAGGCTTCTGGATTCACCTTTACTAGCTCTGCTATGCAGTGGGTGCGACAGGCTCGTG<br>GACAACGCCTTGAGTGGATAGGATGGATCGTCGTTGGCAGTGGTAACACAAACTACGCACAG<br>AAGTTCCAGGAAAGAGTCACCATTACCAGGGACATGTCCACAAGCACAGCCTACATGGAGCT<br>GAGCAGCCTGAGATCCGAGGACACGGCCGTGTATTACTGTGCGGCAGCTCCGTATTACGATA<br>TTTTGACTGGTTATTATTTATGGGGCCAGGGAACGCTGGTCACCGTCTCCTCAGGTGGAGGC<br>GGTTCTGGCGGAGGTGGCTCTGGCGGTGGCGGATCGCAGTCTGCCCTGACTCAGCCACCCTC<br>AGCGTCTGGGACCCCCGGGCAGAGGGTCACCATCTCTTGTTCTGGAAGCGGCTCCAACATCG<br>GAAGTAATGATGTCTCCTGGTATCAGCAGATCCCAGGAACGGCCCCCAAACTCCTCATCTAC<br>TGGAATGATCAGCGGCCCTCAGGGGTCCCTGACCGATTCTCTGGCTCCAAGTCTGGCACCTC<br>AGCCTCCCTGGCCATCAGTGGGCTCCAGTCTGAGGATGAGGCTGATTATTACTGTGCATCAT<br>GGGATGACAGCCTGAGTGGTTGGGTGTTCGGCGGAGGGACCAAGCTGACCGTCCTA | BCMA-16 scFv (nt) |
| 346 | CAGGTTCAGCTGGTGCAGTCTGGGGGAGGCTTGGTCAAGCCTGGAGGGTCCCTGAGACTCTC<br>CTGTGCAGCCTCTGGATTCACCTTCAGTGACTACTACATGAGCTGGATCCGCCTGGCTCCAG<br>GGAAGGGGCTGGAGTGGGTTTCATACATTAGTAGTAGTGGTAGTACCATATACTACGCAGAC<br>TCTGTGAAGGGCCGATTCACCATCTCCAGGGACAACGCCAAGAACTCACTGTATCTGCAAAT<br>GAACAGCCTGAGAGCCGAGGACACGGCCGTGTATTACTGTGCGAGAGAGGCCGATAGTAGCG<br>CTGACTACTGGGGCCAGGGAACCCTGGTCAACGTCTCCTCAGGTGGAGGCGGTTCAGGCGGA<br>GGTGGCTCTGGCGGTGGCGGATCGCAGCCTGTGCTGACTCAGCCACCCTCGGTGTCAGTGGC<br>CCCAGGAAAGACGGCCATGATTACCTGTGGGGGAAACAACATTGGATTTAAAGGTGTGCAGT<br>GGTACCAGCAGAAGACAGGCCAGGCCCCTGTGCTGGTCGTCTATGATGATAGCGACCGGCCC<br>TCAGGGATCCCTGAGCGATTCTCTGGCTCCAACTCTGGGAACACGGCCACCCTGACCATCAG<br>CAGGGTCGAAGCCGGGGATGAGGCCGATTATTACTGTCAGGTGTGGGATAGTGCTAGTGATC<br>ATTGGGTGTTCGGCGGAGGGACCAAGCTGACCGTCCTA | BCMA-17 scFv (nt) |
| 347 | GAGGTGCAGCTGTTGGAGTCTGGGGGAGGCTTGGTCCAGCCTGGGGGGTCCCTGAGACTCTC<br>CTGTGCAGCCTCTGGATTCACGTTTAGTAGCTATTGGATGAGCTGGACCGCCAGGCTCCAG<br>GGAAGGGGCCGGAGTGGGTGGCCCACATAAACCAAGACGGAAGTGAGAAGTACTATGTGGAC<br>TCTGTGAAGGGCCGATTCACCATCTCCAGAGACAACGCCGAGAGTTCACTGTATCTGCAAAT<br>GAACAGCCTGAGAGCCGAGGACACGGCTGTGTATTACTGTGCGAGGTGGCTGGCGGTTACTA<br>ACTGGGGCCAGGGAACCCTGGTCACCGTCTCCTCAGGTGGAGGCGGTTCAGGCGGAGGTGGC<br>TCTGGCGGTGGCGGATCGCAGTCTGTGTTGACTCAGCCACCCTCAGCGTCTGGGACCCCCGG<br>GCAGAGGGTCACCATCTCTTGTTCTGGAAGCGGCTCCAACATCGGAAGTAATGATGTCTCCT<br>GGTATCAGCAGATCCCAGGGACGGCCCCCAAACTCCTCATCTACTGGAATGATCAGCGGCCC<br>TCAGGGGTCCCTGACCGATTCTCTGGCTCCAAGTCTGGCACCTCAGCCTCCCTGGCCATCAG<br>TGGGCTCCGGTCCGAGGATGAGGCTGATTATTACTGTGCAGCATGGGATGACAGCCTGAATG<br>GTTGGGTGTTCGGCGGAGGGACCAAGCTGACCGTCCTA | BCMA-18 scFv (nt) |
| 348 | CAGGTCCAGCTGGTACAGTCTGGGGCTGAGGTGAAGAAGCCTGGGGCCTCAGTGAAGGTCTC<br>CTGCAAGGCTTCTGGATACACCTTCACCAGCTACTATATGCACTGGGTGCGACAGGCCCCTG<br>GACAAGGGCTTGAGTGGATGGGATGGATCAACCCTAACAGTGGTGGCACAAACTATGCACAG<br>AAGTTTCAGGGCAGGGTCACCATGACCAGGGACACGTCCATCAGCACAGCCTACATGGAGCT<br>GAGCAGGCTGAGATCTGACGACACGGCCGTGTATTACTGTGCGAGAGATGGTGGGGACGTCT<br>GGGGCCAAGGGACCACGGTCACCGTCTCCTCAGGTGGAGGCGGTTCAGGCGGAGGTGGCTCT<br>GGCGGTGGCGGATCGCAGGCTGTGCTGACTCAGCCTGCCTCCGTGTCTGGGTCTCCTGGACA<br>GTCGATCACCATCTCCTGCACTGGAACCAGCAGTGACGTTGGTGATTATAACTATGTCGCCT<br>GGTATCAACAACACCCAGGCAAAGACCCCAAACTCATGATTTTTGAGGTCATTAATCGGCCC<br>TCAGGGGTTTCTGATCGCTTCTCTGGCTCCAAGTCTGGCAACACGGCCTCCCTGGACATCTC<br>TGGGCTCCAGCCTGAGGACGAGGCTGATTATTACTGCATCTCATATTCACGAGGCAGCACTC<br>CTTATGTCATCGGAACTGGGACCAAGGTGACCGTCCTA | BCMA-19 scFv (nt) |
| 349 | GAGGTGCAGCTGTTGGAGTCTGGGGGAGGCTTGGTACAGCCTGGCAGGTCCCTGAGACTCTC<br>CTGTGCAGCCTCTGGATTCACCTTTGATGATTATGCCATGCACTGGGTCCGGCAAGCTCCAG<br>GGAAGGGCCTGGAGTGGGTCTCAGGTATTAGTTGGAATAGTGGTAGCATAGGCTATGCGGAC<br>TCTGTGAAGGGCCGATTCACCATCTCCAGAGACAACGCCAAGAACTCCCTGTATCTGCAAAT<br>GAACAGTCTGAGAGCTGAGGACACGGCCTTGTATTACTGTGCAAAGGGGGCCTAGGAATAAC<br>CCCATACTACTTTGACTACTGGGGCCAGGGAACCCTGGTCACCGTCTCCTCAGGTGGAGGC<br>GGTTCAGGCGGAGGTGGCTCTGGCGGTGGCGGATCGCAGCCTGTGCTGACTCAGCCACCCTC<br>AGCGTCTGGGACCCCCGGGCAGAGGGTCACCATCTCTTGTTCGGGAGGCAAGACTGTAAACT<br>GGTTCCGGCAGGTCCCAGGAACGGCCCCCCAACTCCTCATCTATAGTAATGATCAGCGGCCC<br>TCAGGGGTCCCTGACCGATTCTCTGGCTCCAAGTCTGGCTCCTCAGCCTCCCTGGACATCTC<br>TGGGCTCCAGTCTGAGGATGAGGCTTATTATTACTGTGGATCATGGGATGACAGCCTCAATG<br>CTTGGGTGTTCGGCGGAGAGACCAAGCTGACCGTCCTA | BCMA-20 scFv (nt) |
| 350 | GAAGTGCAGCTGGTGGAGTCTGGGGGAGGCTTGGTCAAGCCTGGAGGGTCCCTGAAACTCTC<br>CTGTGCAGCCTCTGGATTCACCTTCAGTGACTACTACATGAGCTGGATCCGCCAGGCTCCAG | BCMA-21 scFv (nt) |

-continued

| SEQ ID NO | SEQUENCE | Description |
|---|---|---|
| | GGAAGGGGCTGGAGTGGGTTTCATACATTAGTAGTAGTGGTAGTACCATATACTACGCAGAC<br>TCTGTGAAGGGCCGATTCACCATCTCCAGGGACAACGCCAAGAACTCACTGTATCTGCAAAT<br>GAACAGCCTGAGAGCCGAGGACACGGCCGTGTATTACTGTGCGAAAGTAGACGGAGGCTACA<br>CAGAGGACTACTGGGGCCAGGGAACCCTGGTCACCGTCTCCTCAGGTGGAGGCGGTTCAGGC<br>GGAGGTGGCTCTGGCGGTGGCGGATCGCAGTCTGTGCTGACTCAGCCACCCTCAGCGTCTGG<br>GACCCCCGGGCAGAGGGTCACCATCTCTTGTTCTGGAAGCGGCTCCAACATCGGAAGTAATG<br>ATGTCTCCTGGTATCAGCAGATCCCAGGAACGGCCCCCAAACTCCTCATCTACTGGAATGAT<br>CAGCGGCCCTCAGGGGTCCCTGACCGGTTCTCAGGCTCCAAGTCTGGCATCTCAGCCTCCCT<br>GGCCATCAGCGGGCTCCGGTCCGAGGATGAGGCTGATTATTACTGTGCAGCATGGGATGACA<br>GCCTGAATGGTTATGTCTTCGGAACTGGGACCAAGGTCACCGTCCTA | |
| 351 | GAAGTGCAGCTGGTGGAGTCTGGGGGAGGCTTGGTCAAGCCTGGAGGGTCCCTGAGACTCTC<br>CTGTGCAGCCTCTGGATTCACCTTCAGTGACTACTACATGAGCTGGATCCGCCAGGCTCCAG<br>GGAAGGGGCTGGAGTGGGTTTCATACATTAGTAGTAGTGGTAGTACCATATACTACGCAGAC<br>TCTGTGAAGGGCCGATTCACCATCTCCAGGGACAACGCCAAGAACTCACTGTATCTGCAAAT<br>GAACAGCCTGAGAGCCGAGGACACGGCCGTGTATTACTGTGCGAAAGTAGACGGAGACTACA<br>CAGAGGACTACTGGGGCCAGGGAACCCTGGTCACCGTCTCCTCAGGTGGAGGCGGTTCAGGC<br>GGAGGTGGCTCTGGCGGTGGCGGATCGCAGTCTGCCCTGACTCAGCCTGCCTCCGTGTCTGG<br>GTCTCCTGGACAGTCGATCACTATCTCCTGCACTGGAAGCAGCAGTGATGTTGGCAAATATA<br>ATCTTGTCTCCTGGTACCAACAGCCCCCAGGCAAAGCCCCCAAGCTCATAATTTATGACGTC<br>AATAAGCGGCCCTCAGGGGTTTCTAATCGCTTCTCTGGCTCCAAGTCTGGCAACACGGCCAC<br>CCTGACAATCTCTGGGCTCCAGGGTGACGACGAGGCTGATTATTATTGTTGCTCATATGGAG<br>GTAGTAGGTCTTATGTCTTCGGAACTGGGACCAAGGTGACCGTCCTA | BCMA-22 scFv (nt) |
| 352 | GAAGTGCAGCTGGTGGAGTCTGGGGGAGGCTTGGTCAAGCCTGGAGGGTCCCTGAGACTCTC<br>CTGTGCAGCCTCTGGATTCACCTTCAGTGACTACTACATGAGCTGGATCCGCCAGGCTCCAG<br>GGAAGGGGCTGGAGTGGGTTTCATACATTAGTAGTAGTGGTAGTACCATATACTACGCAGAC<br>TCTGTGAAGGGCCGATTCACCATCTCCAGGGACAACGCCAAGAACTCACTGTATCTGCAAAT<br>GAACAGCCTGAGAGCCGAGGACACGGCCGTGTATTACTGTGCGAAAGTAGACGGAGACTACA<br>CAGAGGACTACTGGGGCCAGGGAACCCTGGTCACCGTCTCCTCAGGTGGAGGCGGTTCAGGC<br>GGAGGTGGCTCTGGCGGTGGCGGATCGCAGTCTGCCCTGACTCAGCCTGCCTCCGTGTCTGG<br>GTCTCCTGGACAGTCGATCACTATCTCCTGCACTGGAAGCAGCAGTGATGTTGGCAAATATA<br>ATCTTGTCTCCTGGTACCAACAGCCCCCAGGCAAAGCCCCCAAGCTCATAATTTATGACGTC<br>AATAAGCGGCCCTCAGGGGTTTCTAATCGCTTCTCTGGCTCCAAGTCTGGCAACACGGCCAC<br>CCTGACAATCTCTGGGCTCCAGGGTGACGACGAGGCTGATTATTATTGTAGCTCATATGGAG<br>GTAGTAGGTCTTATGTCTTCGGAACTGGGACCAAGGTGACCGTCCTA | BCMA-23 scFv (nt) |
| 353 | $X_1X_2X_3MX_4$<br>$X_1$ = D or S;<br>$X_2$ = Y or S;<br>$X_3$ = A, G, W, or Y;<br>$X_4$ = H, Q, or S | Consensus CDR-H1 |
| 354 | $X_1IX_2X_3X_4X_5X_6X_7X_8X_9X_{10}X_{11}YX_{12}\ X_{13}\ X_{14}\ X_{15}\ X_{16}\ X_{17}$<br>$X_1$ = F, G, H, V, W or Y;<br>$X_2$ = N, R, S or V;<br>$X_3$ = P, Q, S, V, W or Y;<br>$X_4$ = K or null;<br>$X_5$ = A or null;<br>$X_6$ = D, G, N, S, or Y;<br>$X_7$ = G or S;<br>$X_8$ = G or S;<br>$X_9$ = E, G, N, T or S;<br>$X_{10}$ = I, K, or T;<br>$X_{11}$ = E, G, N or Y;<br>$X_{12}$ = A or V;<br>$X_{13}$ = A, D or Q;<br>$X_{14}$ = K or S;<br>$X_{15}$ = F or V;<br>$X_{16}$ = K or Q;<br>$X_{17}$ = E or G | Consensus CDR-H2 |
| 355 | $X_1X_2X_3X_4X_5X_6X_7X_8X_9X_{10}X_{11}X_{12}X_{13}X_{14}$<br>$X_1$ = A, D, E, G, L, V or W;<br>$X_2$ = A, D, G, L, P, Q or S;<br>$X_3$ = A, D, G, L or Y;<br>$X_4$ = D, G, P, R, S, V, Y or null;<br>$X_5$ = D, I, P, S, T, Y or null;<br>$X_6$ = A, G, I, S, T, V, Y or null;<br>$X_7$ = A, D, E, F, L, P, S, Y or null;<br>$X_8$ = P, Q, T, Y or null;<br>$X_9$ = D, G, R, Y or null;<br>$X_{10}$ = A, F, Y or null; | Consensus CDR-H3 |

-continued

| SEQ ID NO | SEQUENCE | Description |
|---|---|---|
| | $X_{11}$ = D, F or null;<br>$X_{12}$ = F or null;<br>$X_{13}$ = D, T or Y;<br>$X_{14}$ = I, L, N, V or Y | |
| 356 | $X_1X_2X_3X_4X_5X_6X_7X_8X_9X_{10}X_{11}X_{12}X_{13}X_{14}$ $X_{15}$ $X_{16}$ $X_{17}$<br>$X_1$ = G, K, R, S or T;<br>$X_2$ = A, G or S;<br>$X_3$ = G, N, S or T;<br>$X_4$ = G, K, N, Q, R or S;<br>$X_5$ = S or null;<br>$X_6$ = D, N, V or null;<br>$X_7$ = L, V or null;<br>$X_8$ = H, S, Y or null;<br>$X_9$ = S, T or null;<br>$X_{10}$ = S or null;<br>$X_{11}$ = D, G, I, N, S or null;<br>$X_{12}$ = D, E, G, K, I, N or null;<br>$X_{13}$ = F, G, K, N, R, S, Y or null;<br>$X_{14}$ = D, K, N, T or null;<br>$X_{15}$ = A, D, G, L, N, S, T or Y;<br>$X_{16}$ = L or V;<br>$X_{17}$ = A, H, N, Q or S | Consensus CDR-L1 |
| 357 | $X_1X_2X_3X_4X_5X_6X_7$<br>$X_1$ = A, D, E, N, S, V or W;<br>$X_2$ = A, D, N, S or V;<br>$X_3$ = A, D, H, I, N or S;<br>$X_4$ = D, K, N, Q, R or T;<br>$X_5$ = L, R or V;<br>$X_6$ = A, E, P or Q;<br>$X_7$ = A, D, S or T | Consensus CDR-L2 |
| 358 | $X_1X_2X_3X_4X_5X_6X_7X_8X_9X_{10}X_{11}X_{12}$<br>$X_1$ = A, C, G, H, I, Q or S;<br>$X_2$ = A, Q, S or V;<br>$X_3$ = S, W or Y;<br>$X_4$ = D, F, G, H or Y;<br>$X_5$ = D, G, M, R, S or T;<br>$X_6$ = A, G, H, L, R, S, T or Y;<br>$X_7$ = L, P, R, S or null;<br>$X_8$ = D, G, N, R, S, T or null;<br>$X_9$ = A, G, H, L, P or null;<br>$X_{10}$ = F, S or null;<br>$X_{11}$ = L, P, W or Y;<br>$X_{12}$ = S, T or V | Consensus CDR-L3 |
| 359 | GGGGS | 4GS linker (aa) |
| 360 | GGGS | 3GS linker (aa) |
| 361 | GGGGSGGGGSGGGGS | (4GS)$_3$ linker (aa) |
| 362 | GSTSGSGKPGSGEGSTKG | Linker (aa) |
| 363 | ESKYGPPCPPCP | Spacer (IgG4hinge) (aa) |
| 364 | gaatctaagtacggaccgccctgccccccttgccct | Spacer (IgG4hinge) (nt) |
| 365 | ESKYGPPCPPCPGQPREPQVYTLPPSQEEMTKNQVSLTCLVKGFYPSDIAVEWESNGQPENN<br>YKTTPPVLDSDGSFFLYSRLTVDKSRWQEGNVFSCSVMHEALHNHYTQKSLSLSLGK | Hinge-C$_H$3 spacer (aa) |
| 366 | ESKYGPPCPPCPAPEFLGGPSVFLFPPKPKDTLMISRTPEVTCVVVDVSQEDPEVQFNWYVD<br>GVEVHNAKTKPREEQFNSTYRVVSVLTVLHQDWLNGKEYKCKVSNKGLPSSIEKTISKAKGQ<br>PREPQVYTLPPSQEEMTKNQVSLTCLVKGFYPSDIAVEWESNGQPENNYKTTPPVLDSDGSF<br>FLYSRLTVDKSRWQEGNVFSCSVMHEALHNHYTQKSLSLSLGK | Hinge-C$_H$2-C$_H$3 spacer (aa) |
| 367 | MLQMAGQCSQNEYFDSLLHACIPCQLRCSSNTPPLTCQRYCNASVTNSVKGTNAILWTCLGL<br>SLIISLAVFVLMFLLRKISSEPLKDEFKNTGSGLLGMANIDLEKSRTGDEIILPRGLEYTVE<br>ECTCEDCIKSKPKVDSDHCFPLPAMEEGATILVTTKTNDYCKSLPAALSATEIEKSISAR | Human BCMA; GenBank No. BAB60895.1 |

-continued

| SEQ ID NO | SEQUENCE | Description |
|---|---|---|
| 368 | MLQMAGQCSQNEYFDSLLHACIPCQLRCSSNTPPLTCQRYCNASVTNSVKGTNAILWTCLGL SLIISLAVFVLMFLLRKINSEPLKDEFKNTGSGLLGMANIDLEKSRTGDEIILPRGLEYTVE ECTCEDCIKSKPKVDSDHCFPLPAMEEGATILVTTKTNDYCKSLPAALSATEIEKSISAR | Human BCMA; NCBI No. NP_001183.2 |
| 369 | MLQMAGQCSQNEYFDSLLHACIPCQLRCSSNTPPLTCQRYCNARSGLLGMANIDLEKSRTGD EIILPRGLEYTVEECTCEDCIKSKPKVDSDHCFPLPAMEEGATILVTTKTNDYCKSLPAALS ATEIEKSISAR | Human BCMA Variant; GenBank No. ABN42510.1 |
| 370 | MAQQCFHSEYFDSLLHACKPCHLRCSNPPATCQPYCDPSVTSSVKGTYTVLWIFLGLTLVLS LALFTISFLLRKMNPEALKDEPQSPGQLDGSAQLDKADTELTRIRAGDDRIFPRSLEYTVEE CTCEDCVKSKPKGDSDHFFPLPAMEEGATILVTTKTGDYGKSSVPTALQSVMGMEKPTHTR | Mouse BCMA; NCBI No. NP_035738.1 |
| 371 | MLQMARQCSQNEYFDSLLHDCKPCQLRCSSTPPLTCQRYCNASMTNSVKGMNAILWTCLGLS LIISLAVFVLTFLLRKMSSEPLKDEFKNTGSGLLGMANIDLEKGRTGDEIVLPRGLEYTVEE CTCEDCIKNKPKVDSDHCFPLPAMEEGATILVTTKTNDYCNSLSAALSVTEIEKSISAR | Cynomolgus BCMA; GenBank No. EHH60172.1 |
| 372 | GISWNSGSIXYADSVKG | BCMA-28 CDR-H2 (aa) Kabat numbering |
| 373 | YISGSGSTIYYADSVKG | BCMA-33 CDR-H2 (aa) Kabat numbering |
| 374 | YISSSGNTIYYADSVKG | BCMA-41 CDR-H2 Kabat numbering |
| 375 | CIPCQLR | human BCMA epitope (residues 21-27) |
| 376 | DLGPPYGDDAFDI | BCMA-24, -28, -29, -39 CDR-H3 (aa) |
| 377 | DLDPDDAFDI | BCMA-30 CDR-H3 (aa) |
| 378 | VDGDYDDY | BCMA-35 CDR-H3 (aa) |
| 379 | SNTPPLTCQR | human BCMA epitope (residues 30-39) |
| 380 | RASQGISNYLA | BCMA-25 CDR-L1 (aa) |
| 381 | RSSQSLLHSNGYNYLD | BCMA-28 CDR-L1 (aa) |
| 382 | TGTSSDVGSYNLVS | BCMA-29 CDR-L1 (aa) |
| 383 | RASQPIRSNLA | BCMA-30 CDR-L1 (aa) |
| 384 | KSSQSVLNSSNNKNYVA | BCMA-31 CDR-L1 (aa) |
| 385 | GGNNIGSKGVH | BCMA-32 CDR-L1 (aa) |
| 386 | RASQSISNYLA | BCMA-34 CDR-L1 (aa) |
| 387 | GSSTGPVTSAHSPS | BCMA-36 CDR-L1 (aa) |
| 388 | GSSTGAVTNGHSPY | BCMA-37, -38 CDR-L1 (aa) |
| 389 | RASQGIRYELX | BCMA-39 CDR-L1 (aa) |
| 390 | TGSSSDVSKYNLVS | BCMA-40 CDR-L1 (aa) |
| 391 | SGSSSNIGGNSVD | BCMA-41 CDR-L1 (aa) |
| 392 | RASQGIGNGLA | BCMA-42 CDR-L1 (aa) |
| 393 | SVTNSVK | human BCMA epitope (residues 44-50) |
| 394 | KSSQNLLYSSNNKNYLA | BCMA-44 CDR-L1 (aa) |
| 395 | RASQGIGRSLA | BCMA-45 CDR-L1 (aa) |

-continued

| SEQ ID NO | SEQUENCE | Description |
|---|---|---|
| 396 | GGNNIGSKSVH | BCMA-47, -48 CDR-L1 (aa) |
| 397 | GGDQIGRKSVH | BCMA-49 CDR-L1 (aa) |
| 398 | RASQNIGDWLA | BCMA-51 CDR-L1 (aa) |
| 399 | WGSTRES | BCMA-24 CDR-L2 (aa) |
| 400 | SASTLQS | BCMA-25 CDR-L2 (aa) |
| 401 | LGSNRAS | BCMA-28 CDR-L2 (aa) |
| 402 | EVSKRPS | BCMA-29 CDR-L2 (aa) |
| 403 | SASTRAT | BCMA-30 CDR-L2 (aa) |
| 404 | DASNRAT | BCMA-34 CDR-L2 (aa) |
| 405 | ETTNRHS | BCMA-36 CDR-L2 (aa) |
| 406 | DTTNRHS | BCMA-37 CDR-L2 (aa) |
| 407 | DTNNRHS | BCMA-38 CDR-L2 (aa) |
| 408 | AASTLQS | BCMA-39 CDR-L2 (aa) |
| 409 | ANDRRPS | BCMA-41 CDR-L2 (aa) |
| 410 | CSQNEYF | human BCMA epitope (residues 8-15) |
| 411 | DASSLRS | BCMA-45 CDR-L2 (aa) |
| 412 | YDTDRPS | BCMA-47, -48 CDR-L2 (aa) |
| 413 | YDSDRPS | BCMA-49 CDR-L2 (aa) |
| 414 | GASILES | BCMA-51 CDR-L2 (aa) |
| 415 | QQYISLPWT | BCMA-24 CDR-L3 (aa) |
| 416 | QQSYTSRQT | BCMA-25 CDR-L3 (aa) |
| 417 | MQALQTPPWT | BCMA-28 CDR-L3 (aa) |
| 418 | CSYAGSSTSRDV | BCMA-29 CDR-L3 (aa) |
| 419 | RHYAPLT | BCMA-30 CDR-L3 (aa) |
| 420 | QQRSNWPPYT | BCMA-34 CDR-L3 (aa) |
| 421 | HLWDRSRDHYV | BCMA-26, -35 CDR-L3 (aa) |
| 422 | LLSSGDARMV | BCMA-36 CDR-L3 (aa) |
| 423 | SLSHAGDRVF | BCMA-37 CDR-L3 (aa) |
| 424 | LLSYSDARLA | BCMA-38 CDR-L3 (aa) |
| 425 | LQHNSYPLT | BCMA-39 CDR-L3 (aa) |
| 426 | ESWDDALNGHV | BCMA-41 CDR-L3 (aa) |
| 427 | QQYVEDALT | BCMA-42 CDR-L3 (aa) |
| 428 | LLHACIPCQLR | human BCMA epitope (residues 17-27) |
| 429 | QQYYSSPYT | BCMA-44 CDR-L3 (aa) |

| SEQ ID NO | SEQUENCE | Description |
|---|---|---|
| 430 | QQLNGYPWT | BCMA-45 CDR-L3 (aa) |
| 431 | QLWDSDSDDFA | BCMA-47 CDR-L3 (aa) |
| 432 | QVWDSSTGQYVV | BCMA-49 CDR-L3 (aa) |
| 433 | QKYDGAPPWT | BCMA-51 CDR-L3 (aa) |
| 434 | EVQLLESGGGLVQPGRSLRLSCVASGFTFD | BCMA-27 VH FR1 (aa) |
| 435 | QVQLVQSGGGLVQPGRSLRLSCAASGFTFG | BCMA-30 VH FR1 (aa) |
| 436 | EVQLVQSGGGLVQPGRSLRLSCTASGFTFG | BCMA-25, -31, -44, -51 VH FR1 (aa) |
| 437 | QVQLVESGGGLVKPGGSLRLSCAASGFTFS | BCMA-32, -49 VH FR1 (aa) |
| 438 | TGQLVQSGGGLVQPGRSLRLSCAASGFTFD | BCMA-34 VH FR1 (aa) |
| 439 | EVQLLESGGGLVQPGRSLRLSCTASGFTFG | BCMA-42 VH FR1 (aa) |
| 440 | agctatgagctgacacagcctccaagcgcctctggcacacctggacagcgagtgacaatgagctgtagcggcaccagcagcaacatcggcagccacagcgtgaactggtatcagcagctgcctggcacagcccctaaactgctgatctacaccaacaaccagcggcctagcggcgtgcccgatagattttctggcagcaagagcggcacaagcgccagcctggctatttctggactgcagagcgaggacgaggccgactattattgtgccgcctgggacggctctctgaacggccttgtttttggcggagcaccaagctgacagtgctgggatctagaggtggcggaggatctggcggcggaggaagcggaggcggcggatctcttgaaatggctgaagtgcagctggtgcagtctggcgccgaagtgaagaagcctggcgagagcctgaagatcagctgcaaaggcagcggctacagcttcaccagctactgatcggctgggtccgacagatgcctggcaaaggccttgagtggatgggcatcatctaccccggcgacagcgacaccagatacagccctagcttcagggccacgtgaccatcagcgccgacaagtctatcagcaccgcctacctgcagtggtccagcctgaaggcctctgacaccgccatgtactactgcgccagatactctggcagcttcgacaattggggccagggcacactggtcaccgtgtccagc | BCMA-52 scFv (nt) (O/SSE) |
| 441 | RFTISRDNAKSSLYLQMNSLRAEDTAVYYCAR | BCMA-37 VH FR3 (aa) |
| 442 | SYELTQPPSASGTPGQRVTMSCSGTSSNIGSHSVNWYQQLPGTAPKLLIYTNNQRPSGVPDRFSGSKSGTSASLAISGLQSEDEADYYCAAWDGSLNGLVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGHVTISADKSISTAYLQWSSLKASDTAMYYCARYSGSFDNWGQGTLVTVSS | BCMA-52 scFv (aa) |
| 443 | DSPSPGTTPKNSLYLQMNSLRAEDTAVYYCAK | BCMA-47 VH FR3 (aa) |
| 444 | GGQGTMVTVSS | BCMA-28 VH FR4 (aa) |
| 445 | WRQGTMVTVSS | BCMA-47 VH FR4 (aa) |
| 446 | DIQMTQSPAFLSASVGDRVTVTC | BCMA-25 VL FR1 (aa) |
| 447 | DIVMTQSPLSLSVTPGEPASISC | BCMA-28 VL FR1 (aa) |
| 448 | QPVLTQPASVSGSPGQSITISC | BCMA-29 VL FR1 (aa) |
| 449 | EIVLTQSPATLSVSPGERATLSC | BCMA-30 VL FR1 (aa) |
| 450 | DVVMTQSPDSLAVSLGERATISC | BCMA-31 VL FR1 (aa) |
| 451 | QTVVTQPPSVSVAPGQTARITC | BCMA-32 VL FR1 (aa) |
| 452 | EIVMTQSPATLSLSPGDRATLSC | BCMA-34 VL FR1 (aa) |
| 453 | NFMLTQPPSVSVAPGQTARITC | BCMA-35 VL FR1 (aa) |
| 454 | QSVLTQEPSLTVSPGETVTLTC | BCMA-36 VL FR1 (aa) |
| 455 | QLVLTQEPSLTVSPGGTVTLTC | BCMA-37 VL FR1 (aa) |
| 456 | QAVLTQEPSLTVSPGGTVTLTC | BCMA-38 VL FR1 (aa) |
| 457 | DIQXTQSPSSLSASVGDRVTITC | BCMA-39 VL FR1 (aa) |
| 458 | QPVLTQPPSVSGTPGQRVTIPC | BCMA-41 VL FR1 (aa) |

-continued

| SEQ ID NO | SEQUENCE | Description |
|---|---|---|
| 459 | DIQMTQSPSLVSASVGDRVTITC | BCMA-42 VL FR1 (aa) |
| 460 | cagtctgccctgacacagcctgccagcgttagtgctagtcccggacagtctatcgccatcag ctgtaccggcaccagctctgacgttggctggtatcagcagcaccctggcaaggcccctaagc tgatgatctacgaggacagcaagaggcccagcggcgtgtccaatagattcagcggcagcaag agcggcaacaccgccagcctgacaattagcggactgcaggccgaggacgaggccgattacta ctgcagcagcaacacccggtccagcacactggttttggcggaggcaacaagctgacagtgc tgggatctagaggtggcggaggatctggcggcggaggaagcggaggcggcggatctcttgaa atggctgaagtgcagctggtgcagtctggcgccgagatgaagaaacctggcgcctctctgaa gctgagctgcaaggccagcggctacaccttcatcgactactacgtgtactggatgcggcagg cccctggacagggactcgaatctatgggctggatcaaccccaatagcggcggcaccaattac gcccagaaattccagggcagagtgaccatgaccagagacaccagcatcagcaccgcctacat ggaactgagccggctgagatccgacgacaccgccatgtactactgcgcagatctcagcgcg acggctacatggattattggggccagggaaccctggtcaccgtgtccagc | BCMA-55 scFv (nt) (O/SSE) |
| 461 | DVVMTQSPDSLAVSLGERATINC | BCMA-44 VL FR1 (aa) |
| 462 | AIRMTQSPSSLSASVGDRVTITC | BCMA-45 VL FR1 (aa) |
| 463 | QAVLTQPPSVSVAPGKTATITC | BCMA-47 VL FR1 (aa) |
| 464 | QPVLTQPPSVSVAPGKTATITC | BCMA-48 VL FR1 (aa) |
| 465 | LPVLTQPPSVSVAPGKTARITC | BCMA-49 VL FR1 (aa) |
| 466 | AIQLTQSPSTLSASVGDRVAITC | BCMA-51 VL FR1 (aa) |
| 467 | WYQQKPGNAPRLLIY | BCMA-25 VL FR2 (aa) |
| 468 | WYLQKPGQSPQLLIY | BCMA-28 VL FR2 (aa) |
| 469 | WYQQHPGKAPKLMIY | BCMA-29 VL FR2 (aa) |
| 470 | WYQQKPGQAPKLLTY | BCMA-30 VL FR2 (aa) |
| 471 | WYKQKPGQPPKLVIS | BCMA-31 VL FR2 (aa) |
| 472 | WYRQRPGQAPEVVIY | BCMA-32 VL FR2 (aa) |
| 473 | WFQKKPGQAPTTLTY | BCMA-36 VL FR2 (aa) |
| 474 | WFQQKPGQAPRTLTY | BCMA-37, -38 VL FR2 (aa) |
| 475 | WYQQKPGKAPKLLTY | BCMA-39 VL FR2 (aa) |
| 476 | WFQEVPGTAPKLLTY | BCMA-41 VL FR2 (aa) |
| 477 | WYQQKPGKAPKLLLF | BCMA-42 VL FR2 (aa) |
| 478 | QSALTQPASVSASPGQSTATSCTGTSSDVGWYQQHPGKAPKLMIYEDSKRPSGVSNRFSGSK SGNTASLTISGLQAEDEADYYCSSNTRSSTLVFGGGTKLTVLGSRGGGSGGGGSGGGGSLE MAEVQLVQSGAEMKKPGASLKLSCKASGYTFIDYYVYWMRQAPGQGLESMGWINPNSGGTNY AQKFQGRVTMTRDTSISTAYMELSRLRSDDTAMYYCARSQRDGYMDYWGQGTLVTVSS | BCMA-55 scFv (aa) |
| 479 | WYKQKPGGVPQLLIH | BCMA-45 VL FR2 (aa) |
| 480 | WYQRKPGQGPVVVIQ | BCMA-47, -48 VL FR2 (aa) |
| 481 | WYQQKPGQAPVLVMS | BCMA-49 VL FR2 (aa) |
| 482 | WYQQKPGKAPKLLIF | BCMA-51 VL FR2 (aa) |
| 483 | GVPDRFSGSGSGTDFTLTISSLQAEDVAIYHC | BCMA-24 VL FR3 (aa) |
| 484 | GVPSRFRGTGYGTEFSLTIDSLQPEDFATYYC | BCMA-25 VL FR3 (aa) |
| 485 | GVPDRFSGSGSGTDFTLKISRVEAEDVGVYYC | BCMA-28 VL FR3 (aa) |
| 486 | GVSNRFSGSKSGNTASPTISGLQAEDEADYYC | BCMA-29 VL FR3 (aa) |

-continued

| SEQ ID NO | SEQUENCE | Description |
|---|---|---|
| 487 | GIPDRFSGSGSGTDFTLTISRLEHEDFAVYYR | BCMA-30 VL FR3 (aa) |
| 488 | GVPDRFSGSNSGNTATLTVRGVEAGDEADYYC | BCMA-32 VL FR3 (aa) |
| 489 | GIPARFSGSGSGTDFTLTISSLEPEDFAVYYC | BCMA-34 VL FR3 (aa) |
| 490 | WTPARFSGSLLGGKAALTLSGAQPEDEADYYC | BCMA-36 VL FR3 (aa) |
| 491 | WTPARFSGSLLGGKAALTLSGAQPEDEAEYYC | BCMA-37 VL FR3 (aa) |
| 492 | WTPARFSGSLLGGKAALTLSGAQPEDEADYFC | BCMA-38 VL FR3 (aa) |
| 493 | GVPSRFSGSGSGTDFALTIRSLQPEDFATYYC | BCMA-39 VL FR3 (aa) |
| 494 | GVPDRFSGTKSGTSASLAIRGLQSDDDAHYYC | BCMA-41 VL FR3 (aa) |
| 495 | GVPSRFSGSRSGTDYTLTISSLQPEDVATYYC | BCMA-42 VL FR3 (aa) |
| 496 | gaggtgcagctggtgcagtctggagcagaggtgaaaaagcccggggagtctctgaagatctc ctgtaagggttctggatacagctttaccagctactggatcggctgggtgcgccagatgcccg ggaaaggcctggagtggatgggatcatctatcctggtgactctgataccagatacagcccg tccttccaaggccacgtcaccatctcagctgacaagtccatcagcactgcctacctgcagtg gagcagcctgaaggcctcggacaccgccatgtattactgtgcgcgctactctggttctttcg ataactggggtcaaggtactctggtgaccgtctcctcagc | BCMA-52 VH chain (nt) |
| 497 | GVPSRFSGSGSGTEFTLTISGVQSEDSATYHC | BCMA-45 VL FR3 (aa) |
| 498 | GIPERFSGSKSGDTASLTISGVEAGDEADYYC | BCMA-47 VL FR3 (aa) |
| 499 | GIPERFSGSNSGNTATLTISRVEAGDEGDYYC | BCMA-48 VL FR3 (aa) |
| 500 | GIPERFSGSNSGNTATLTISRVEAGDEAAYYC | BCMA-49 VL FR3 (aa) |
| 501 | GVPSRFSGSGSGTDFTLTISSLQPEDVAVYYC | BCMA-51 VL FR3 (aa) |
| 502 | FGPGTRLDIK | BCMA-25 VL FR4 (aa) |
| 503 | FGXGTKLTVL | BCMA-29 VL FR4 (aa) |
| 504 | FGQGTKLDIK | BCMA-31, -34 VL FR4 (aa) |
| 505 | FGTGTKLDIK | BCMA-35 VL FR4 (aa) |
| 506 | FGGGTKVDIK | BCMA-42 VL FR4 (aa) |
| 507 | SYWIG | BCMA-52 CDR-H1 (aa)- Kabat numbering |
| 508 | FGQGTKVEIK | BCMA-24, -28, -51 VL FR4 (aa) |
| 509 | GFTFGDYAMH | BCMA-30 CDR-H1 (aa) AbM numbering |
| 510 | GISWNSGSIX | BCMA-28 CDR-H2 (aa) AbM numbering |
| 511 | YISGSGSTIY | BCMA-33 CDR-H2 (aa) AbM numbering |
| 512 | YISSSGNTIY | BCMA-41 CDR-H2 AbM numbering |
| 513 | IIYPGDSDTRYSPSFQG | BCMA-52 CDR-H2 (aa)- Kabat numbering |
| 514 | SWNSG | BCMA-28 CDR-H2 (aa) Chothia numbering |
| 515 | SGSGST | BCMA-33 CDR-H2 (aa) Chothia numbering |

| SEQ ID NO | SEQUENCE | Description |
|---|---|---|
| 516 | SSSGNT | BCMA-41 CDR-H2 Chothia numbering |
| 517 | YSGSFDN | BCMA-52 CDR-H3 (aa)- Kabat, Chothia, and AbM numbering |
| 518 | EVQLVQSGGGLVKPGGSLRLSCAASGFTFSDYYMSWIRQAPGKGLEWVSGISWNSGSIGYAD SVKGRFTISRDNAKNSLYLQMNSLRAEDTAVYYCARDLGPPYGDDAFDIWGQGTMVTVSS | BCMA-24 VH chain (aa) |
| 519 | EVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSS | BCMA-25, -31, -44, -51 VH chain (aa) |
| 520 | EVQLLESGGGLVQPGRSLRLSCVASGFTFDDYAMHWVRQAPGKGLEWVSGISWNSGSIGYAD SVKGRFTISRDNAKNSLYLQMNSLRAEDTALYYCAKGGLGITPYYFDYWGQGTLVTVSS | BCMA-27 VH chain (aa) |
| 521 | QVQLVQSGGGLVQPGRSLRLSCAASGFTFDDYAMHWVRQAPGKGLEWVSGISWNSGSIXYAD SVKGRFTISRDNAKNSLYLQMNSLRAEDTAVYYCARDLGPPYGDDAFDIGGQGTMVTVSS | BCMA-28 VH chain (aa) |
| 522 | QVQLVQSGGGLVQPGRSLRLSCAASGFTFDDYAMHWVRQAPGKGLEWVSGISWNSGSIGYAD SVKGRFTISRDNAKNSLYLQMNSLRAEDTAVYYCARDLGPPYGDDAFDIWGQGTMVTVSS | BCMA-29, -39 VH chain (aa) |
| 523 | QVQLVQSGGGLVQPGRSLRLSCAASGFTFGDYAMHWVRQAPGKGLEWVSGISWNSGSIGYAD SVKGRFTISRDNAKNSLYLQMNSLRAEDTAVYYCARDLDPDDAFDIWGQGTMVTVSS | BCMA-30 VH chain (aa) |
| 524 | QVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGPPSFDIWGQGTMVTVSS | BCMA-32, -49 VH chain |
| 525 | QVQLVQSGGGLVKPGGSLRLSCAASGFTFSDYYMSWIRQAPGKGLEWVSYISGSGSTIYYAD SVKGRFTISRDNAKNSLYLQMNSLRAEDTAVYYCAREADSSADYWGQGTLVNVSS | BCMA-33 VH chain (aa) |
| 526 | TGQLVQSGGGLVQPGRSLRLSCAASGFTFDDYAMHWVRQAPGKGLEWVSGISWNSGSIGYAD SVKGRFTISRDNAKNSLYLQMNSLRAEDTAVYYCARDLGPDYDPDAFDIWGQGTMVTVSS | BCMA-34 VH chain (aa) |
| 527 | EVQLVQSGGGLVKPGGSLRLSCAASGFTFSDYYMSWIRQAPGKGLEWVSYISSSGSTIYYAD SVKGRFTISRDNAKNSLYLQMNSLRAEDTAVYYCARVDGDYDDYWGQGTLVTVSS | BCMA-35 VH chain (aa) |
| 528 | QVQLVQSGGGLVKPGGSLRLSCAASGFTFSDYYMSWIRQAPGKGLEWVSYISSSGSTIYYAD SVKGRFTISRDNAKNSLYLQMNSLRAEDTAVYYCARVDGDYVDDYWGQGTLVTVSS | BCMA-36, 38 VH chain (aa) |
| 529 | EVQLVQSGGGLVKPGGSLRLSCAASGFTFSDYYMSWIRQAPGKGLEWVSYISSSGSTIYYAD SVKGRFTISRDNAKSSLYLQMNSLRAEDTAVYYCARVDGDYVDDYWGQGTLVTVSS | BCMA-37 VH chain (aa) |
| 530 | QVQLVQSGGGLVKPGGSLRLSCAASGFTFSDYYMSWIRQAPGKGLEWVSYISSSGNTIYYAD SVKGRFTISRDNAKNSLYLQMNSLRAEDTAVYYCAKVDGDYVDDYWGQGTLVTVSS | BCMA-41 VH chain (aa) |
| 531 | EVQLLESGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSS | BCMA-42 VH chain (aa) |
| 532 | GYSFTSY | BCMA-52 CDR-H1 (aa)- Chothia numbering |
| 533 | QVQLLESGGGLVKPGGSLRLSCAASGFTFSDYYMSWIRQAPGKGLEWVSYISSSGSTIYYAD SVKGDSPSPGTTPKNSLYLQMNSLRAEDTAVYYCAKVDGPPSFDIWRQGTMVTVSS | BCMA-47 VH chain (aa) |
| 534 | DIVMTQSPDSLAVSLGERATINCKSSQSVLYSSNNKNYLAWYQQKPGQPPKLLIYWGSTRES GVPDRFSGSGSGTDFTLTISSLQAEDVAIYHCQQYISLPWTFGQGTKVEIK | BCMA-24 VL chain (aa) |
| 535 | DIQMTQSPAFLSASVGDRVTVTCRASQGISNYLAWYQQKPGNAPRLLIYSASTLQSGVPSRF RGTGYGTEFSLTIDSLQPEDFATYYCQQSYTSRQTFGPGTRLDIK | BCMA-25 VL chain (aa) |
| 536 | SYVLTQPPSVSVAPGQTARITCGANNIGSKSVHWYQQKPGQAPMLVVYDDDDRPSGIPERFS GSNSGNTATLTISGVEAGDEADYCHLWDRSRDHYVFGTGTKLTVL | BCMA-26 VL chain (aa) |
| 537 | DIVMTQSPLSLSVTPGEPASISCRSSQSLLHSNGYNYLDWYLQKPGQSPQLLIYLGSNRASG VPDRFSGSGSGTDFTLKISRVEAEDVGVYYCMQALQTPPWTFGQGTKVEIK | BCMA-28 VL chain (aa) |
| 538 | QPVLTQPASVSGSPGQSITISCTGTSSDVGSYNLVSWYQQHPGKAPKLMIYEVSKRPSGVSN RFSGSKSGNTASPTISGLQAEDEADYYCCSYAGSSTSRDVFGXGTKLTVL | BCMA-29 VL chain (aa) |
| 539 | EIVLTQSPATLSVSPGERATLSCRASQPIRSNLAWYQQKPGQAPKLLIYSASTRATGIPDRF SGSGSGTDFTLTISRLEHEDFAVYYRRHYAPLTFGGGTKVEIK | BCMA-30 VL chain (aa) |

| SEQ ID NO | SEQUENCE | Description |
|---|---|---|
| 540 | DVVMTQSPDSLAVSLGERATISCKSSQSVLNSSNNKNYVAWYKQKPGQPPKLVISWASTRES GVPDRFSGSGSGTDFTLTISSLQAEDVAVYYCQQYYSTPYTFGQGTKLDIK | BCMA-31 VL chain (aa) |
| 541 | QTVVTQPPSVSVAPGQTARITCGGNNIGSKGVHWYRQRPGQAPEVVIYDDSDRPSGVPDRFS GSNSGNTATLTVRGVEAGDEADYYCQVWDSSSDHWVFGGGTKLTVL | BCMA-32 VL chain (aa) |
| 542 | EIVMTQSPATLSLSPGDRATLSCRASQSISNYLAWYQQKPGQAPRLLIYDASNRATGIPARF SGSGSGTDFTLTISSLEPEDFAVYYCQQRSNWPPYTFGQGTKLDIK | BCMA-34 VL chain (aa) |
| 543 | NFMLTQPPSVSVAPGQTARITCGANNIGSKSVHWYQQKPGQAPMLVVYDDDDRPSGIPERFS GSNSGNTATLTISGVEAGDEADYCHLWDRSRDHYVFGTGTKLDIK | BCMA-35 VL chain (aa) |
| 544 | QSVLTQEPSLTVSPGETVTLTCGSSTGPVTSAHSPSWFQKKPGQAPTTLIYETTNRHSWTPA RFSGSLLGGKAALTLSGAQPEDEADYYCLLSSGDARMVFGGGTKLTVL | BCMA-36 VL chain (aa) |
| 545 | QLVLTQEPSLTVSPGGTVTLTCGSSTGAVTNGHSPYWFQQKPGQAPRTLIYDTTNRHSWTPA RFSGSLLGGKAALTLSGAQPEDEAEYYCSLSHAGDRVFFGGGTKLTVL | BCMA-37 VL chain (aa) |
| 546 | QAVLTQEPSLTVSPGGTVTLTCGSSTGAVTNGHSPYWFQQKPGQAPRTLIYDTNNRHSWTPA RFSGSLLGGKAALTLSGAQPEDEADYFCLLSYSDARLAFGGGTKLTVL | BCMA-38 VL chain (aa) |
| 547 | DIQXTQSPSSLSASVGDRVTITCRASQGIRYELXWYQQKPGKAPKLLIYAASTLQSGVPSRF SGSGSGTDFALTIRSLQPEDFATYYCLQHNSYPLTFGRGTKLEIK | BCMA-39 VL chain (aa) |
| 548 | QSALTQPASVSGSPGQSITISCTGSSSDVSKYNLVSWYQQPPGKAPKLIIYDVNKRPSGVSN RFSGSKSGNTATLTISGLQGDDEADYYCCSYGGSRSYVFGTGTKLTVL | BCMA-40 VL chain (aa) |
| 549 | QPVLTQPPSVSGTPGQRVTIPCSGSSSNIGGNSVDWFQEVPGTAPKLLIYANDRRPSGVPDR FSGTKSGTSASLAIRGLQSDDDAHYYCESWDDALNGHVFGGGTKLTVL | BCMA-41 VL chain (aa) |
| 550 | DIQMTQSPSLVSASVGDRVTITCRASQGIGNGLAWYQQKPGKAPKLLLFAASRLESGVPSRF SGSRSGTDYTLTISSLQPEDVATYYCQQYVEDALTFGGGTKVDIK | BCMA-42 VL chain (aa) |
| 551 | YPGDSD | BCMA-52 CDR-H2 (aa)-Chothia numbering |
| 552 | DVVMTQSPDSLAVSLGERATINCKSSQNLLYSSNNKNYLAWYQQKPGQPPKLLIYWASTRES GVPDRFSGSGSGTDFTLTISSLQAEDVAVYYCQQYYSSPYTFGQGTKLEIK | BCMA-44 VL chain (aa) |
| 553 | AIRMTQSPSSLSASVGDRVTITCRASQGIGRSLAWYKQKPGGVPQLLIHDASSLRSGVPSRF SGSGSGTEFTLTISGVQSEDSATYHCQQLNGYPWTFGQGTKVDIK | BCMA-45 VL chain (aa) |
| 554 | QAVLTQPPSVSVAPGKTATITCGGNIGSKVHWYQRKPGQGPVVVIQYDTDRPSGIPERFS GSKSGDTASLTISGVEAGDEADYYCQLWDSDSDDFAFGTGTKLTVL | BCMA-47 VL chain (aa) |
| 555 | QPVLTQPPSVSVAPGKTATITCGGNNIGSKSVHWYQRKPGQGPVVVIQYDTDRPSGIPERFS GSNSGNTATLTISRVEAGDEGDYYCQVWDSSSDHWVFGGGTKLTVL | BCMA-48 VL chain (aa) |
| 556 | LPVLTQPPSVSVAPGKTARITCGGDQIGRKSVHWYQQKPGQAPVLVMSYDSDRPSGIPERFS GSNSGNTATLTISRVEAGDEAAYYCQVWDSSTGQYVVFGGGTKLTVL | BCMA-49 VL chain (aa) |
| 557 | AIQLTQSPSTLSASVGDRVAITCRASQNIGDWLAWYQQKPGKAPKLLIFGASILESGVPSRF SGSGSGTDFTLTISSLQPEDVAVYYCQKYDGAPPWTFGQGTKVEIK | BCMA-51 VL chain (aa) |
| 558 | EVQLVQSGGGLVKPGGSLRLSCAASGFTFSDYYMSWIRQAPGKGLEWVSGISWNSGSIGYAD SVKGRFTISRDNAKNSLYLQMNSLRAEDTAVYYCARDLGPPYGDDAFDIWGQGTMVTVSSGG GGGSGGGGSGGGGSDIVMTQSPDSLAVSLGERATINCKSSQSVLYSSNNKNYLAWYQQKPGQP PKLLIYWGSTRESGVPDRFSGSGSGTDFTLTISSLQAEDVAIYHCQQYISLPWTFGQGTKVE IK | BCMA-24 scFv sequence (aa) |
| 559 | EVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGS GGGGSGGGGSDIQMTQSPAFLSASVGDRVTVTCRASQGISNYLAWYQQKPGNAPRLLIYSAST LQSGVPSRFRGTGYGTEFSLTIDSLQPEDFATYYCQQSYTSRQTFGPGTRLDIK | BCMA-25 scFv sequence (aa) |
| 560 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGPPSFDIWGQGTMVTVSSGGGGS GGGSGGGGSSYVLTQPPSVSVAPGQTARITCGANNIGSKSVHWYQQKPGQAPMLVVYDDDDR PSGIPERFSGSNSGNTATLTISGVEAGDEADYFCHLWDRSRDHYVFGTGTKLTVL | BCMA-26 scFv sequence (aa) |

| SEQ ID NO | SEQUENCE | Description |
|---|---|---|
| 561 | EVQLLESGGGLVQPGRSLRLSCVASGFTFDDYAMHWVRQAPGKGLEWVSGISWNSGSIGYAD SVKGRFTISRDNAKNSLYLQMNSLRAEDTALYYCAKGGLGITPYYFDYWGQGTLVTVSSGGG GSGGGGSGGGGSQPVLTQPPSASGTPGQRVTISCSGGKTVNWFRQVPGTAPQLLIYSNDQRP SGVPDRFSGSKSGSSASLDISGLQSEDEAYYYCGSWDDSLNAWVFGGETKLTVL | BCMA-27 scFv sequence (aa) |
| 562 | QVQLVQSGGGLVQPGRSLRLSCAASGFTFDDYAMHWVRQAPGKGLEWVSGISWNSGSIXYAD SVKGRFTISRDNAKNSLYLQMNSLRAEDTAVYYCARDLGPPYGDDAFDIGGQGTMVTVSSGG GGSGGGGSGGGGSDIVMTQSPLSLSVTPGEPASISCRSSQSLLHSNGYNYLDWYLQKPGQSP QLLIYLGSNRASGVPDRFSGSGSGTDFTLKISRVEAEDVGVYYCMQALQTPPWTFGQGTKVE IK | BCMA-28 scFv sequence (aa) |
| 563 | QVQLVQSGGGLVQPGRSLRLSCAASGFTFDDYAMHWVRQAPGKGLEWVSGISWNSGSIGYAD SVKGRFTISRDNAKNSLYLQMNSLRAEDTAVYYCARDLGPPYGDDAFDIWGQGTMVTVSSGG GGSGGGGSGGGGSQPVLTQPASVSGSPGQSITISCTGTSSDVGSYNLVSWYQQHPGKAPKLM IYEVSKRPSGVSNRFSGSKSGNTASPTISGLQAEDEADYYCCSYAGSSTSRDVFGXGTKLTV L | BCMA-29 scFv sequence (aa) |
| 564 | QVQLVQSGGGLVQPGRSLRLSCAASGFTFGDYAMHWVRQAPGKGLEWVSGISWNSGSIGYAD SVKGRFTISRDNAKNSLYLQMNSLRAEDTAVYYCARDLPDDAFDIWGQGTMVTVSSGGGGS GGGGSGGGGSEIVLTQSPATLSVSPGERATLSCRASQPIRSNLAWYQQKPGQAPKLLIYSAS TRATGIPDRFSGSGSGTDFTLTISRLEHEDFAVYYRRHYAPLTFGGGTKVEIK | BCMA-30 scFv sequence (aa) |
| 565 | EVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDVVMTQSPDSLAVSLGERATISCKSSQSVLNSSNNKNYVAWYKQPGQPPKLV ISWASTRESGVPDRFSGSGSGTDFTLTISSLQAEDVAVYYCQQYYSTPYTFGQGTKLDIK | BCMA-31 scFv sequence (aa) |
| 566 | QVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGPPSFDIWGQGTMVTVSSGGGGSG GGGSGGGGSQTVVTQPPSVSVAPGQTARITCGGNNIGSKGVHWYRQRPGQAPEVVIYDDSDR PSGVPDRFSGSNSGNTATLTVRGVEAGDEADYYCQVWDSSSDHWVFGGGTKLTVL | BCMA-32 scFv sequence (aa) |
| 567 | QVQLVQSGGGLVKPGGSLRLSCAASGFTFSDYYMSWIRQAPGKGLEWVSYISGSGSTIYYAD SVKGRFTISRDNAKNSLYLQMNSLRAEDTAVYYCAREADSSADYWGQGTLVNVSSGGGGSGG GGSGGGGSQPVLTQPPSVSVAPGKTAMITCGGNNIGFKGVQWYQQKTGQAPVLVVYDDSDRP SGIPERFSGSNSGNTATLTISRVEAGDEADYYCQVWDSASDHWVFGGGTKLTVL | BCMA-33 scFv sequence (aa) |
| 568 | TGQLVQSGGGLVQPGRSLRLSCAASGFTFDDYAMHWVRQAPGKGLEWVSGISWNSGSIGYAD SVKGRFTISRDNAKNSLYLQMNSLRAEDTAVYYCARDLGPDYDPDAFDIWGQGTMVTVSSGG GGSGGGGSGGGGSEIVMTQSPATLSLSPGDRATLSCRASQSISNYLAWYQQKPGQAPRLLIY DASNRATGIPARFSGSGSGTDFTLTISSLEPEDFAVYYCQQRSNWPPYTFGQGTKLDIK | BCMA-34 scFv sequence (aa) |
| 569 | EVQLVQSGGGLVKPGGSLRLSCAASGFTFSDYYMSWIRQAPGKGLEWVSYISSSGSTIYYAD SVKGRFTISRDNAKNSLYLQMNSLRAEDTAVYYCARVDGDYDDYWGQGTLVTVSSGGGGSGG GGSGGGGSNFMLTQPPSVSVAPGQTARITCGANNIGSKSVHWYQQKPGQAPMLVVYDDDDRP SGIPERFSGSNSGNTATLTISGVEAGDEADYFCHLWDRSRDHYVFGTGTKLDIK | BCMA-35 scFv sequence (aa) |
| 570 | QVQLVQSGGGLVKPGGSLRLSCAASGFTFSDYYMSWIRQAPGKGLEWVSYISSSGSTIYYAD SVKGRFTISRDNAKNSLYLQMNSLRAEDTAVYYCARVDGDYVDDYWGQGTLVTVSSGGGGSG GGGSGGGGSQSVLTQEPSLTVSPGETVTLTCGSSTGPVTSAHSPSWFQKKPGQAPTTLIYET TNRHSWTPARFSGSLLGGKAALTLSGAQPEDEADYYCLLSSGDARMVFGGGTKLTVL | BCMA-36 scFv sequence (aa) |
| 571 | EVQLVQSGGGLVKPGGSLRLSCAASGFTFSDYYMSWIRQAPGKGLEWVSYISSSGSTIYYAD SVKGRFTISRDNAKSSLYLQMNSLRAEDTAVYYCARVDGDYVDDYWGQGTLVTVSSGGGGSG GGGSGGGGSQLVLTQEPSLTVSPGGTVTLTCGSSTGAVTNGHSPYWFQQKPGQAPRTLIYDT TNRHSWTPARFSGSLLGGKAALTLSGAQPEDEAEYYCSLSHAGDRVFFGGGTKLTVL | BCMA-37 scFv sequence (aa) |
| 572 | QVQLVQSGGGLVKPGGSLRLSCAASGFTFSDYYMSWIRQAPGKGLEWVSYISSSGSTIYYAD SVKGRFTISRDNAKNSLYLQMNSLRAEDTAVYYCARVDGDYVDDYWGQGTLVTVSSGGGGSG GGGSGGGGSQAVLTQEPSLTVSPGGTVTLTCGSSTGAVTNGHSPYWFQQKPGQAPRTLIYDT NNRHSWTPARFSGSLLGGKAALTLSGAQPEDEADYFCLLSYSDARLAFGGGTKLTVL | BCMA-38 scFv sequence (aa) |
| 573 | QVQLVQSGGGLVQPGRSLRLSCAASGFTFDDYAMHWVRQAPGKGLEWVSGISWNSGSIGYAD SVKGRFTISRDNAKNSLYLQMNSLRAEDTAVYYCARDLGPPYGDDAFDIWGQGTMVTVSSGG GGSGGGGSGGGGSDIQXTQSPSSLSASVGDRVTITCRASQGIRYELXWYQQKPGKAPKLLIY AASTLQSGVPSRFSGSGSGTDFALTIRSLQPEDFATYYCLQHNSYPLTFGRGTKLEIK | BCMA-39 scFv sequence (aa) |
| 574 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGDYTEDYWGQGTLVTVSSGGGGSG GGGSGGGGSQSALTQPASVSGSPGQSITISCTGSSSDVSKYNLVSWYQQPPGKAPKLIIYDV NKRPSGVSNRFSGSKSGNTATLTISGLQGDDEADYYCCSYGGSRSYVFGTGTKLTVL | BCMA-40 scFv sequence (aa) |

| SEQ ID NO | SEQUENCE | Description |
|---|---|---|
| 575 | QVQLVQSGGGLVKPGGSLRLSCAASGFTFSDYYMSWIRQAPGKGLEWVSYISSSGNTIYYAD SVKGRFTISRDNAKNSLYLQMNSLRAEDTAVYYCAKVDGDYVDDYWGQGTLVTVSSGGGGSG GGGSGGGGSQPVLTQPPSVSGTPGQRVTIPCSGSSSNIGGNSVDWFQEVPGTAPKLLIYAND RRPSGVPDRFSGTKSGTSASLAIRGLQSDDDAHYYCESWDDALNGHVFGGGTKLTVL | BCMA-41 scFv sequence (aa) |
| 576 | EVQLLESGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDIQMTQSPSLVSASVGDRVTITCRASQGIGNGLAWYQQKPGKAPKLLLFAASR LESGVPSRFSGSRSGTDYTLTISSLQPEDVATYYCQQYVEDALTFGGGTKVDIK | BCMA-42 scFv sequence (aa) |
| 577 | GYSFTSYWIG | BCMA-52 CDR-H1 (aa)- AbM numbering |
| 578 | EVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSDVVMTQPDSLAVSLGERATINCKSSQNLLYSSNNKNYLAWYQQKPGQPPKLL IYWASTRESGVPDRFSGSGSGTDFTLTISSLQAEDVAVYYCQQYYSSPYTFGQGTKLEIK | BCMA-44 scFv sequence (aa) |
| 579 | QVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSAIRMTQSPSSLSASVGDRVTITCRASQGIGRSLAWYKQPGGVPQLLIHDASS LRSGVPSRFSGSGSGTEFTLTISGVQSEDSATYHCQQLNGYPWTFGQGTKVDIK | BCMA-45 scFv sequence (aa) |
| 580 | QVQLLESGGGLVKPGGSLRLSCAASGFTFSDYYMSWIRQAPGKGLEWVSYISSSGSTIYYAD SVKGDSPSPGTTPKNSLYLQMNSLRAEDTAVYYCAKVDGPPSFDIWRQGTMVTVSSGGGGSG GGGSGGGGSQAVLTQPPSVSVAPGKTATITCGGNNIGSKSVHWYQRKPGQGPVVVIQYDTDR PSGIPERFSGSKSGDTASLTISGVEAGDEADYYCQLWDSDSDDFAFGTGTKLTVL | BCMA-47 scFv sequence (aa) |
| 581 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGPPSFDIWGQGTMVTVSSGGGGSG GGGSGGGGSQPVLTQPPSVSVAPGKTATITCGGNNIGSKSVHWYQRKPGQGPVVVIQYDTDR PSGIPERFSGSNSGNTATLTISRVEAGDEGDYYCQVWDSSSDHWVFGGGTKLTVL | BCMA-48 scFv sequence (aa) |
| 582 | QVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGPPSFDIWGQGTMVTVSSGGGGSG GGGSGGGGSLPVLTQPPSVSVAPGKTARITCGGDQIGRKSVHWYQQKPGQAPVLVMSYDSDR PSGIPERFSGSNSGNTATLTISRVEAGDEAAYYCQVWDSSTGQYVVFGGGTKLTVL | BCMA-49 scFv sequence (aa) |
| 583 | EVQLVQSGGGLVQPGRSLRLSCTASGFTFGDYAMSWFRQAPGKGLEWVGFIRSKAYGGTTEY AASVKGRFTISRDDSKSIAYLQMNSLKTEDTAVYYCAAWSAPTDYWGQGTLVTVSSGGGGSG GGGSGGGGSAIQLTQPSPSTLSASVGDRVAITCRASQNIGDWLAWYQQKPGKAPKLLIFGASI LESGVPSRFSGSGSGTDFTLTISSLQPEDVAVYYCQKYDGAPPWTFGQGTKVEIK | BCMA-51 scFv sequence (aa) |
| 584 | CAGGTGCAGCTGGTGCAATCTGGGGGAGGCTTGGTCAAGCCTGGAGGGTCCCTGAGACTCTC CTGTGCAGCCTCTGGATTCACCTTCAGTGACTACTACATGAGCTGGATCCGCCAGGCTCCAG GGAAGGGGCTGGAGTGGGTTTCATACATTAGTAGTAGTGGTAATACCATATACTACGCAGAC TCTGTAAAGGGCCGATTCACCATCTCCAGGGACAACGCCAAAAACTCACTGTATCTGCAAAT GAACAGCCTGAGAGCCGAGGACACGGCCGTGTATTACTGTGCGAAAGTGGACGGTGACTACG TCGATGACTACTGGGGCCAGGGAACCCTGGTCACCGTCTCCTCAGGTGGAGGCGGTTCAGGC GGAGGTGGCTCTGGCGGTGCGGATCGCAGCCTGTGCTGACTCAGCCACCCTCAGTGTCTGG GACCCCCGGGCAGAGGGTCACCATCCCTTGTTCTGGAAGCAGCTCCAACATCGGAGGTAACT CTGTAGACTGGTTCCAGGAGGTCCCAGGGACGGCCCCCAAACTCCTCATCTACGCTAATGAT CGGCGGCCCTCGGGTGTCCCTGACCGCTTCTCTGGCACCAAGTCGGGCACCTCAGCCTCCT GGCCATCAGGGGGCTCCAGTCTGACGATGACGCTCATTATTACTGTGAATCCTGGGACGATG CCCTGAACGGTCACGTGTTCGGCGGAGGGACCAAGCTGACCGTCCTA | BCMA-41 scFv sequence (nt) |
| 585 | QIQLVQSGPELKKPGETVKISCKASGYTFTDYSINWVKRAPGKGLKWMGWINTETREPAYAY DFRGRFAFSLETSASTAYLQINNLKYEDTATYFCALDYSYAMDYWGQGTSVTVSSGGGGSGG GGSGGGGSDIVLTQSPPSLAMSLGKRATISCRASESVTILGSHLIHWYQQKPGQPPTLLIQL ASNVQTGVPARFSGSGSRTDFTLTIDPVEEDDVAVYYCLQSRTIPRTFGGGTKLEIK | BCMA-C1 VH-VL scFv (aa) |
| 586 | DVVMTQSHRFMSTSVGDRVSITCRASQDVNTAVSWYQQKPGQSPKLLIFSASYRYTGVPDRF TGSGSGADFTLTISSVQAEDLAVYYCQQHYSTPWTFGGGTKLDIKGGGGSGGGGSGGGGSQI QLVQSGPDLKKPGETVKLSCKASGYTFTNFGMNWVKQAPGKGFKWMAWINTYTGESYFADDF KGRFAFSVETSATTAYLQINNLKTEDTATYFCARGEIYYGYDGGFAYWGQGTLVTVSA | BCMA-C2 VL-VH scFv (aa) |
| 587 | IIYPGDSDTR | BCMA-52 CDR-H2 (aa)- AbM numbering |
| 588 | gaagtgcagctggtgcagtctggcgccgaagtgaagaagcctggcgagagcctgaagatcag ctgcaaggcagcggctacagcttcaccagctactggatcggctgggtccgacagatgcctg gcaaaggccttgagtggatgggcatcatctaccccggcgacagcgacaccagatacagccct agctttcagggccacgtgaccatcagcgccgacaagtctatcagcaccgcctacctgcagtg | BCMA-52 VH chain (nt) (O/SSE) |

| SEQ ID NO | SEQUENCE | Description |
|---|---|---|
| | gtccagcctgaaggcctctgacaccgccatgtactactgcgccagatactctggcagcttcg<br>acaattggggccagggcacactggtcaccgtgtccagc | |
| 589 | SGTSSNIGSHSVN | BCMA-52 CDR-L1 (aa)-<br>Kabat, Chothia, and AbM<br>numbering |
| 590 | TNNQRPS | BCMA-52 CDR-L2 (aa)-<br>Kabat, Chothia, and AbM<br>numbering |
| 591 | AAWDGSLNGLV | BCMA-52 CDR-L3 (aa)-<br>Kabat, Chothia, and AbM<br>numbering |
| 592 | tcctatgagctgactcagccaccctcagcgtctgggaccccgggcagagggtcaccatgtc<br>ttgttctggaaccagctccaacatcggaagtcactctgtaaactggtaccagcagctcccag<br>gaacggcccccaaactcctcatctatactaataatcagcggccctcaggggtccctgaccga<br>ttctctggctccaagtctggcacctcagcctccctggccatcagtggcctccagtctgagga<br>tgaggctgattattactgtgcagcatgggatggcagcctgaatggtctggtattcggcggag<br>ggaccaagctgaccgtcctaggt | BCMA-52 VL chain (nt) |
| 593 | DYYVY | BCMA-55 CDR-H1 (aa)-<br>Kabat numbering |
| 594 | WINPNSGGTNYAQKFQG | BCMA-55 CDR-H2 (aa)-<br>Kabat numbering |
| 595 | SQRDGYMDY | BCMA-55 CDR-H3 (aa)-<br>Kabat, Chothia, and AbM<br>numbering |
| 596 | GYTFIDY | BCMA-55 CDR-H1 (aa)-<br>Chothia numbering |
| 597 | NPNSGG | BCMA-55 CDR-H2 (aa)-<br>Chothia numbering |
| 598 | GYTFIDYYVY | BCMA-55 CDR-H1 (aa)-<br>AbM numbering |
| 599 | WINPNSGGTN | BCMA-55 CDR-H2 (aa)-<br>AbM numbering |
| 600 | agctatgagctgacacagcctccaagcgcctctggcacacctggacagcgagtgacaatgag<br>ctgtagcggcaccagcagcaacatcggcagccacagcgtgaactggtatcagcagctgcctg<br>gcacagcccctaaactgctgatctacaccaacaaccagcggcctagcggcgtgcccgataga<br>ttttctggcagcaagagcggcacaagcgccagcctggctatttctggactgcagagcgagga<br>cgaggccgactattattgtgccgcctgggacggctctctgaacggccttgttttggcggag<br>gcaccaagctgacagtgctggga | BCMA-52 VL chain (nt)<br>(O/SSE) |
| 601 | TGTSSDVG | BCMA-55 CDR-L1 (aa)-<br>Kabat, Chothia, and AbM<br>numbering |
| 602 | EDSKRPS | BCMA-55 CDR-L2 (aa)-<br>Kabat, Chothia, and AbM<br>numbering |
| 603 | SSNTRSSTLV | BCMA-55 CDR-L3 (aa)-<br>Kabat, Chothia, and AbM<br>numbering |
| 604 | GYSFTSYW | BCMA-52 CDR-H1 (aa) |
| 605 | IYPGDSDT | BCMA-52 CDR-H2 (aa) |
| 606 | ARYSGSFDN | BCMA-52 CDR-H3 (aa) |
| 607 | SSNIGSHS | BCMA-52 CDR-L1 (aa) |
| 608 | TNN | BCMA-52 CDR-L2 (aa) |

| SEQ ID NO | SEQUENCE | Description |
|---|---|---|
| 609 | EVQLVQSGAEVKKPGESLKISCKGSGYSFTSYWIGWVRQMPGKGLEWMGIIYPGDSDTRYSP SFQGHVTISADKSISTAYLQWSSLKASDTAMYYCARYSGSFDNWGQGTLVTVSS | BCMA-52 VH chain (aa) |
| 610 | SYELTQPPSASGTPGQRVTMSCSGTSSNIGSHSVNWYQQLPGTAPKLLIYTNNQRPSGVPDR FSGSKSGTSASLAISGLQSEDEADYYCAAWDGSLNGLVFGGGTKLTVLG | BCMA-52 VL chain (aa) |
| 611 | GYTFIDYY | BCMA-55 CDR-H1 (aa) |
| 612 | INPNSGGT | BCMA-55 CDR-H2 (aa) |
| 613 | ARSQRDGYMDY | BCMA-55 CDR-H3 (aa) |
| 614 | ISCTGTSSD | BCMA-55 CDR-L1 (aa) |
| 615 | EDS | BCMA-55 CDR-L2 (aa) |
| 616 | tcaattggtacgtgg | predicted splice donor site |
| 617 | EVQLVQSGAEMKKPGASLKLSCKASGYTFIDYYVYWMRQAPGQGLESMGWINPNSGGTNYAQ KFQGRVTMTRDTSISTAYMELSRLRSDDTAMYYCARSQRDGYMDYWGQGTLVTVSS | BCMA-55 VH chain (aa) |
| 618 | QSALTQPASVSASPGQSIAISCTGTSSDVGWYQQHPGKAPKLMIYEDSKRPSGVSNRFSGSK SGNTASLTISGLQAEDEADYYCSSNTRSSTLVFGGGTKLTVLG | BCMA-55 VL chain (aa) |
| 619 | atggtgctgcagacccaggtgttcatcagcctgctgctgtggatctccggagcatacgga | human IgG-kappa signal sequence (nt) |
| 620 | MVLQTQVFISLLLWISGAYG | human IgG-kappa signal peptide (aa) |
| 621 | gaatctaagtacggaccgccctgccctcctgccctgctcctcctgtggctggaccaagcgt gttcctgtttccacctaagcctaaagatacccctgatgatttcccgcacacctgaagtgactt gcgtggtcgtggacgtgagccaggaggatccagaagtgcagttcaactggtacgtggacggc gtggaagtccacaatgctaagactaaaccccgagaggaacagtttcagtcaacttaccgggt cgtgagcgtgctgaccgtcctgcatcaggattggctgaacgggaaggagtataagtgcaaag tgtctaataagggactgcctagctccatcgagaaaacaattagtaaggcaaaagggcagcct cgagaaccacaggtgtatacccctgcccctagccaggaggaagaccaagaaccaggtgtc cctgacatgtctggtcaaaggcttctatccaagtgacatcgccgtggagtgggaatcaaatg ggcagcccgagaacaattacaagaccacaccaccccgtgctggactctgatggaagtttcttt ctgtattccaggctgaccgtggataaatctcgctggcagggaggggcaacgtgttctcttgcag tgtcatgcacgaagccctgcacaatcattatacacagaagtcactgagcctgtccctgggca aa | IgG4/IgG2 hinge- IgG2/IgG4 C$_H$2- IgG4 C$_H$3 spacer (nt) |
| 622 | gagtctaaatacggaccgccttgtcctccttgtcccgctcctcctgttgccggaccttccgt gttcctgtttcctccaaagcctaaggacacccctgatgatcagcaggacccctgaagtgacct gcgtggtggtggatgtgtcccaagaggatcccgaggtgcagttcaactggtatgtggacggc gtggaagtgcacaacgccaagaccaagctagaggaacagttccagagcacctacagagt ggtgtccgtgctgacagtgctgcaccaggattggctgaacggcaaagagtacaagtgcaagg tgtccaacaagggcctgcctagcagcatcgagaaaaccatctccaagccaagggccagcca agagagccccaggtttacacactgcctccaagccaagaggaaatgaccaagaatcaggtgtc cctgacatgcctggtcaagggcttctaccccctccgatatcgccgtggaatgggagagcaatg gccagcctgagaacaactacaagaccacacctcctgtgctggacagcgacggcagtttcttc ctgtatagtagactcaccgtggataaatcaagatggcaagagggcaacgtgttcagctgcag cgtgatgcacgaggccctgcacaaccactacacccagaaaagcctgagcctgtctctgggca ag | optimized SSE IgG4/IgG2 hinge-IgG2/IgG4 C$_H$2- IgG4 C$_H$3 spacer (nt) |
| 623 | atgttttgggtgctggtcgtggtcggaggggtgctggcctgttacagcctgctggtgacagt cgctttcatcatcttctgggtg | CD28 transmembrane domain (nt) |
| 624 | MFWVLVVVGGVLACYSLLVTVAFIIFWV | CD28 tmnsmembrane domain (aa) |
| 625 | aagcggggagaaagaaactgctgtatattttcaaacagcccttatgagacctgtgcagac tacccaggaggaagacggatgcagctgtaggtttcccgaggaagaggaaggaggctgtgagc tg | 4-1BB-derived intracellular co-signaling sequence (nt) |
| 626 | KRGRKKLLYIFKQPFMRPVQTTQEEDGCSCRFPEEEEGGCEL | 4-1BB-derived intracellular co-signaling sequence (aa) |
| 627 | agagtcaagttttccaggtccgccgacgctccagcctaccagcaggggcagaaccagctgta caacgagctgaacctgggcagaagggaagagtacgacgtcctggataagcggagaggccggg accctgagatgggcggcaagcctcggcggaagaaccccaggaaggcctgtataacgaactg | CD3-zeta derived intracellular signaling domain (nt) |

| SEQ ID NO | SEQUENCE | Description |
|---|---|---|
| | cagaaagacaagatggccgaggcctacagcgagatcggcatgaagggcgagcggaggcgggg caagggccacgacggcctgtatcagggcctgtccaccgccaccaaggatacctacgacgccc tgcacatgcaggccctgcccccaagg | |
| 628 | RVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR | CD3-zeta derived intracellular signaling domain (aa) |
| 629 | attgaagttatgtatcctcctccttacctagacaatgagaagagcaatggaaccattatcca tgtgaaagggaaacacctttgtccaagtcccctatttcccggaccttctaagccc | CD28 ectodomain spacer (nt) |
| 630 | IEVMYPPPYLDNEKSNGTIIHVKGKHLCPSPLFPGPSKP | CD28 ectodomain spacer (aa) |
| 631 | EGRGSLLTCGDVEENPGP | T2A peptide (aa) |
| 632 | atgcttctcctggtgacaagccttctgctctgtgagttaccacacccagcattcctcctgat cccacgcaaagtgtgtaacggaataggtattggtgaatttaaagactcactctccataaatg ctacgaatattaaacacttcaaaaactgcacctccatcagtggcgatctccacatcctgccg gtggcatttagggggactccttcacacatactcctcctccactggatcccaaggaactggatat tctgaaaaccgtaaaggaaatcacagggttttttgctgattcaggcttggcctgaaaacagga cggaccttccatgcctttgagaacctagaaatcatacgcggcaggaccaagcaacatggtcag ttttctcttgcagtcgtcagcctgaacataacatccttgggattacgctccctcaaggagat aagtgatggagatgtgataatttcaggaaacaaaaatttgtgctatgcaaatacaataaact ggaaaaaactgttttgggacctccggtcagaaaaccaaaattataagcaacagaggtgaaaac agctgcaaggcacaggccaggtctgccatgccttgtgctccccgagggctgctgggccc ggagcccagggactgcgtctcttgccggaatgtcagccgaggcaggaatgcgtggacaagt gcaacctgctggagggtgagccaaggggagtttgtggagaactctgagtgcatacagtgccac ccagagtgcctgcctcaggccatgaacatcacctgcacaggacgggaccagacaactgtat ccagtgtgcccactacattgacggccccactgcgtcaagacctgcccggcaggagtcatgg gagaaaacaacaccctggtctggaagtacgcagacgccggccatgtgtgccactgtgccat ccaaactgcacctacggatgcactgggccaggtcttgaaggctgtccaacgaatgggcctaa gatcccgtccatcgccactgggatggtggggggccctcctcttgctgctggtggtggccctgg ggatcggcctcttcatgtga | truncated EGFR (tEGFR) sequence (nt) |
| 633 | atgctgctcctcgtgacaagcctgctcctgtgtgaactccctcatccagcttttctgctcat tcctcggaaagtgtgcaacggcatcggcatcggagagtttaaggacagcctgagcatcaatg ccaccaacatcaagcacttcaagaattgcaccagcatcagcggcgacctgcacattctgcct gtggcctttagaggcgacagcttcacccacacacctccactggatcccaagagctggatat cctgaaaaccgtgaaagagattaccggattcctcctgatccaagcctggccagagaacagaa ccgatctgcacgccttcgagaacctcgagatcatcagaggccggaccaaacagcacggccag tttagcctggctgtggtgtctctgaacatcaccagtctgggcctgagaagcctgaaagaaat ctccgacggcgacgtgatcatctccggaaacaagaacctgtgctacgccaacaccatcaact ggaagaagctgttcggcacctccggccagaaaacaaagatcatctctaaccggggcgagaac agctgcaaggccaccggacaagtttgtcacgccctgtgtagccctgaaggctgttgggacc cgaacctagagactgtgtgtcctgccggaatgtgtcccggggcagagaatgtgtggataagt gcaacctgctggaaggcgagccccgcgagtttgtggaaaacagcgagtgcatccagtgtcac cccgagtgtctgccccaggccatgaacattacatgcaccggcagaggccccgacaactgtat tcagtgcgcccactacatcgacggccctcactgcgtgaaaacatgtccagctggcgtgatgg gagagaacaacaccctcgtgtggaagtatgccgacgccggacatgtgtgccactgtgtcac cctaattgcacctacggctgtaccggacctggcctggaaggatgccctacaaacggccctaa gatcccagcattgccaccggaatggttggagccctgctgcttctgttggtggtggccctcg gaatcggcctgttcatgtga | truncated EGFR (tEGFR) sequence (nt) (O/SSE) |
| 634 | MLLLVTSLLLCELPHPAFLLIPRKVCNGIGIGEFKDSLSINATNIKHFKNCTSISGDLHILP VAFRGDSFTHTPPLDPQELDILKTVKEITGFLLIQAWPENRTDLHAFENLEIIRGRTKQHGQ FSLAVVSLNITSLGLRSLKEISDGDVIISGNKNLCYANTINWKKLFGTSGQKTKIISNRGEN SCKATGQVCHALCSPEGCWGPEPRDCVSCRNVSRGRECVDKCNLLEGEPREFVENSECIQCH PECLPQAMNITCTGRGPDNCIQCAHYIDGPHCVKTCPAGVMGENNTLVWKYADAGHVCHLCH PNCTYGCTPGLEGCPTNGPKIPSIATGMVGALLLLLVVALGIGLFM | truncated EGFR (tEGFR) sequence (aa) |
| 635 | ggatctgcgatcgctccggtgcccgtcagtgggcagagcgcacatcgcccacagtccccgag aagttgggggagggggtcggcaattgaaccggtgcctagagaaggtggcgcggggtaaactg ggaaagtgatgtcgtgtactggctccgcctttttcccgagggtgggggagaaccgtatataa gtgcagtagtcgccgtgaacgttctttttcgcaacgggtttgccgccagaacacagctgaag cttcgaggggctcgcatctctccttcacgcgcccgccgccctacctgaggccgccatccacg ccggttgagtcgcgttctgccgcctcccgcctgtggtgcctcctgaactgcgtccgccgtct aggtaagtttaaagctcaggtcgagacccgggccttttgtccgcctccctgggagcctacct agactcagccggctctccacgctttgcctgaccctgcttgctcaactctacgtctttgtttc gttttctgttctgcgccgttacagatccaagctgtgaccggcgcctac | EF1alpha promoter with HTLV1 enhancer |
| 636 | aatcaacctctggattacaaaatttgtgaaagattgactggtattcttaactatgttgctcc ttttacgctatgtggatacgctgctttaatgcctttgtatcatgctattgcttcccgtatgg | Woodchuck Hepatitis Virus (WHP) |

| SEQ ID NO | SEQUENCE | Description |
|---|---|---|
|  | ctttcattttctcctccttgtataaatcctggttgctgtctctttatgaggagttgtggccc gttgtcaggcaacgtggcgtggtgtgcactgtgtttgctgacgcaaccccactggttgggg cattgccaccacctgtcagctcctttccgggacttttcgctttcccccctcctattgccacgg cggaactcatcgccgcctgccttgcccgctgctggacaggggctcggctgttgggcactga aattccgtggtgttgtcggggaaatcatcgtcctttccttggctgtcgcctgtgttgccac ctggattctgcgcgggacgtccttctgctacgtcccttcggccctcaatccagcggaccttc cttcccgcggcctgctgccggtctgcgggcctcttccgcgtcttcgccttcgccctcagacg agtcggatctcccctttgggccgcctccccgc | Posttranscriptional Regulatory Element (WPRE) |
| 637 | QNEYF | BCMA-52-scFV-mFc BCMA binding epitope 1 |
| 638 | CIPCQL | BCMA-52-scFV-mFc BCMA binding epitope 2 |
| 639 | CQRYC | BCMA-52-scFV-mFc BCMA binding epitope 3 |
| 640 | MLMAG | BCMA-55-scFV-mFc BCMA binding epitope 1 |
| 641 | YFDSLL | BCMA-55-scFV-mFc BCMA binding epitope 2 |
| 642 | QLRCSSNTPPL | BCMA-55-scFV-mFc BCMA binding epitope 3 |
| 643 | gaagtgcagctggtgcagtctggggctgagatgaagaagcctggggcctcactgaagctctc ctgcaaggcttctggatacaccttcatcgactactatgtatactggatgcgacaggcccctg gacaagggcttgagtccatgggatggatcaaccctaacagtggtggcacaaactatgcacag aagtttcagggcagggtcaccatgaccagggacacgtccatcagcacagcctacatggagct gagcaggctgagatctgacgacaccgccatgtattactgtgcgcgctcccagcgtgacggtt acatggattactggggtcaaggtactctggtgaccgtctcctca | BCMA-55 VH chain (nt) |
| 644 | gaagtgcagctggtgcagtctggcgccgagatgaagaaacctggcgcctctctgaagctgag ctgcaaggccagcggctacaccttcatcgactacacgtgtactggatgcggcaggcccctg gacagggactcgaatctatgggctggatcaaccccaatagcggcaccaattacgaccag aaattccagggcagagtgaccatgaccagagacaccagcatcagcaccgcctacatggaact gagccggctgagatccgacgacaccgccatgtactactgcgccagatctcagcgcgacggct acatggattattggggccagggaaccctggtcaccgtgtccagc | BCMA-55 VH chain (nt) (O/SSE) |
| 645 | caatctgccctgactcagcctgcctccgtgtctgcgtcctgacagtcgatcgccatctc ctgactggaaccagcagtgacgttggttggtatcaacagcacccaggcaaagcccccaaac tcatgatttatgaggacagtaagcggccctcaggggtttctaatcgcttctctggctccaag tctggcaacacggcctcccttgaccatctctgggctccaggctgaggacgaggctgattatta ctgcagctcaaatacaagaagcagcacttgggtgttcggcggagggaccaagctgaccgtcc ta | BCMA-55 VL chain (nt) |
| 646 | cagtctgccctgacacaggcctgccagcgttagtgctagtccccggacagtctatcgccatcag ctgtaccggcaccagctctgacgttggctggtatcagcagcaccctggcaaggcccctaagc tgatgatctacgaggacagcaagaggcccagcggcgtgtccaatagattcagcggcagcaag agcggcaacaccgccagcctgacaattagcggactgcaggccgaggacgaggccgattacta ctgcagcagcaacacccgtccagcacactggttttggcggaggcaccaagctgacagtgc tg | BCMA-55 VL chain (nt) (O/SSE) |
| 647 | tcctatgagctgactcagccaccctcagcgtctgggaccccgggcagagggtcaccatgtc ttgttctggaaccagctccaacatcggaagtcactctgtaaactggtaccagcagctcccag gaacggcccccaaactcctcatctatactaataatcagcggcccctcaggggtccctgaccga ttctctggctccaagtctggcacctcagcctccctggccatcagtggcctccagtctgagga tgaggctgattattactgtgcagcatgggatggcagcctgaatggtctggtattcggcggag ggaccaagctgaccgtcctaggttctagaggtggtggtggtagcggcggcggcggctctggt ggtggtggatccctcgagatggccgaggtgcagctggtgcagtctggagcagaggtgaaaaa gcccggggagtctctgaagatctcctgtaagggttctggatacagctttaccagctactgga tcggctgggtgcgccagatgcccgggaaaggcctggagtggatggggatcatctatcctggt gactctgataccagatacagcccgtccttccaaggccacgtcaccatctcagctgacaagtc catcagcactgcctacctgcagtggagcagcctgaaggcctcggacaccgccatgtattact gtgcgcgctactctggttcttcgataactgggggtcaaggtactctggtgaccgtctcctca | BCMA-52 scFv |
| 648 | caatctgccctgactcagcctgcctccgtgtctgcgtcctgacagtcgatcgccatctc ctgactggaaccagcagtgacgttggttggtatcaacagcacccaggcaaagcccccaaac tcatgatttatgaggacagtaagcggccctcaggggtttctaatcgcttctctggctccaag totggcaacacggcctcccttgaccatctctgggctccaggctgaggacgaggctgattatta ctgcagctcaaatacaagaagcagcacttgggtgttcggcggagggaccaagctgaccgtcc | BCMA-55 scFv |

| SEQ ID NO | SEQUENCE | Description |
|---|---|---|
| | taggttctagaggtggtggtggtagcggcggcggcggctctggtggtggtggatccctcgag<br>atggccgaagtgcagctggtgcagtctggggctgagatgaagaagcctggggcctcactgaa<br>gctctcctgcaaggcttctggatacaccttcatcgactactatgtatactggatgcgacagg<br>cccctggacaagggcttgagtccatgggatggatcaaccctaacagtggtggcacaaactat<br>gcacagaagtttcagggcagggtcaccatgaccagggacacgtccatcagcacagcctacat<br>ggagctgagcaggctgagatctgacgacaccgccatgtattactgtgcgcgctcccagcgtg<br>acggttacatggattactgggtcaaggtactctggtgaccgtctcctca | |
| 649 | ESKYGPPCPPCPAPPVAGPSVFLFPPKPKDTLMISRTPEVTCVVVDVSQEDPEVQFNWYVDG<br>VEVHNAKTKPREEQFQSTYRVVSVLTVLHQDWLNGKEYKCKVSNKGLPSSIEKTISKAKGQP<br>REPQVYTLPPSQEEMTKNQVSLTCLVKGFYPSDIAVEWESNGQPENNYKTTPPVLDSDGSFF<br>LYSRLTVDKSRWQEGNVFSCSVMHEALHNHYTQKSLSLSLGK | IgG4/IgG2 hinge-IgG2/IgG4 $C_H2$-IgG4 $C_H3$ spacer (aa) |
| 650 | ggatctgcgatcgctccggtgcccgtcagtgggcagagcgcacatcgcccacagtccccgag<br>aagttgggggggaggggtcggcaattgaaccggtgcctagagaaggtggcgcggggtaaactg<br>ggaaagtgatgtcgtgtactggctccgcctttttcccgagggtggggagaaccgtatataa<br>gtgcagtagtcgccgtgaacgttcttttcgcaacgggtttgccgccagaacacagctgaag<br>cttcgaggggctcgcatctctccttcacgcgcccgccgccctacctgaggccgccatccacg<br>ccggttgagtcgcgttctgccgcctcccgcctgtggtgcctcctgaactgcgtccgccgtct<br>aggtaagtttaaagctcaggtcgagacccgggcctttgtccggcgctcccttggagctcact<br>agactcagccggctctccacgctttgcctgaccctgcttgctcaactctacgtctttgtttc<br>gttttctgttctgcgccgttacagatccaagctgtgaccggcgcctacggctagcgcc | modified EF1 alpha promoter |
| 651 | tttatttagtctccagaaaaaggggggaatgaaagaccccacctgtaggtttggcaagctag<br>gatcaaggttaggaacagagagacagcagaatatgggccaaacaggatatctgtggtaagca<br>gttcctgccccggctcagggccaagaacagttggaacagcagaatatgggccaaacaggata<br>tctgtggtaagcagttcctgccccggctcagggccaagaacagatggtccccagatgcggtc<br>ccgcccctcagcagtttctagagaaccatcagatgtttccaggggtgccccaaggacctgaaat<br>gaccctgtgccttatttgaactaaccaatcagttcgcttctcgcttctgttcgcgcgcttct<br>gctccccgagctcaataaaagagccca | MND promoter |
| 652 | agagtgaagttcagcagatccgccgacgctccagcctatcagcagggccaaaaccagctgta<br>caacgagctgaacctggggagaagagaagagtacgacgtgctggataagcggagaggcagag<br>atcctgaaatgggcggcaagcccagacggaagaatcctcaagagggcctgtataatgagctg<br>cagaaagacaagatggccgaggcctacagcgagatcggaatgaagggcgagcgcagaagagg<br>caagggacacgatggactgtaccagggcctgagcaccgccaccaaggatacctatgacgcac<br>tgcacatgcaggccctgccaacctaga | CD3-zeta derived intracellular signaling domain (nt) |
| 653 | GSGEGRGSLLTCGDVEENPGP | T2A peptide (aa) |
| 654 | LEGGGEGRGSLLTCGDVEENPGPR | T2A peptide (aa) |
| 655 | ATNFSLLKQAGDVEENPGP | P2A peptide (aa) |
| 656 | GSGATNFSLLKQAGDVEENPGP | P2A peptide (aa) |
| 657 | QCTNYALLKLAGDVESNPGP | E2A peptide (aa) |
| 658 | GSGQCTNYALLKLAGDVESNPGP | E2A peptide (aa) |
| 659 | VKQTLNFDLLKLAGDVESNPGP | F2A peptide (aa) |
| 660 | GSGVKQTLNFDLLKLAGDVESNPGP | F2A peptide (aa) |
| 661 | agtctaaatacggac | Optimized splice donor site |
| 662 | tcaactggtatgtgg | Optimized splice donor site |
| 663 | accatctccaaggcc | Optimized splice donor site |
| 664 | gccccaggtttacac | Optimized splice donor site |
| 665 | tcagcagatccgccg | Optimized splice donor site |
| 666 | ctcctgtgtgaactc | Optimized splice donor site |

| SEQ ID NO | SEQUENCE | Description |
|---|---|---|
| 667 | tcggaaagtgtgcaa | Optimized splice donor site |
| 668 | cagcacggccagttt | Optimized splice donor site |
| 669 | aaccggggcgagaac | Optimized splice donor site |
| 670 | ctggaaggcgagccc | Optimized splice donor site |
| 671 | tgttcatgtgagcgg | Optimized splice donor site (last 4 nt outside of coding region) |
| 672 | cagtttcttcctgtatagtagactcaccgtggataaatcaa | Optimized splice acceptor site |
| 673 | gggcaacgtgttcagctgcagcgtgatgcacgaggccctgc | Optimized splice acceptor site |
| 674 | cggagtgctggcctgttacagcctgctggttaccgtggcct | Optimized splice acceptor site |
| 675 | gctgagagtgaagttcagcagatccgccgacgctccagcct | Optimized splice acceptor site |
| 676 | acacctccactggatccccaagagctggatatcctgaaaac | Optimized splice acceptor site |
| 677 | accggattcctcctgatccaagcctggccagagaacagaac | Optimized splice acceptor site |
| 678 | acggccagtttagcctggctgtggtgtctctgaacatcacc | Optimized splice acceptor site |
| 679 | aggagtaagaggagcaggctcctgcacagtgactacatgaacatgactccccgccgccccgg gcccacccgcaagcattaccagccctatgccccaccacgcgacttcgcagcctatcgctcc | CD28 endo (nt) |
| 680 | RSKRSRLLHSDYMNMTPRRPGPTRKHYQPYAPPRDFAAYRS | CD28 endo (aa) |
| 681 | aagcggggcagaaagaagctgctctacatcttcaagcagcccttcatgcggcccgtgcagac cacacaagaggaagatggctgctcctgcagattccccgaggaagaagaaggcggctgcgagc tg | 4-1BB-derived intracellular co-signaling sequence (nt) |
| 682 | atggtgctgcagacccaggtgttcatcagcctgctgctgtggatctctggcgcctacggc | human IgG-kappa signal sequence (nt) |
| 683 | atggtgctgcagacccaggtgttcatcagcctgctgctgtggatctctggcgcctatgga | human IgG-kappa signal sequence (nt) |
| 684 | atggtgctgcagacacaggtgttcatctccctgctgctgtggatctctggagcatacgga | human IgG-kappa signal sequence (nt) |
| 685 | atggtgctgcagacacaggtgttcatcagcctgctgctgtggatctccggagcatacgga | human IgG-kappa signal sequence (nt) |
| 686 | ctcgagggcggcggagagggcagaggaagtcttctaacatgcggtgacgtggaggagaatcc cggccctagg | T2A peptide (nt) |
| 687 | cttgaaggtggtggcgaaggcagaggcagcctgcttacatgcggagatgtggaagagaaccc cggacctaga | T2A peptide (nt) |
| 688 | atgttctgggtgctcgtggtcgttggcggagtgctggcctgttacagcctgctggttaccgt ggccttcatcatcttttgggtc | CD28 transmembrane domain (nt) |
| 689 | cgtctaggtaagttt | Predicted splice donor site |
| 690 | gaccaaggtgaccgt | Predicted splice donor site |
| 691 | tgcactggtaccagc | Predicted splice donor site |

| SEQ ID NO | SEQUENCE | Description |
|---|---|---|
| 692 | taaactggtaccagc | Predicted splice donor site |
| 693 | atctcctgtaagggt | Predicted splice donor site |
| 694 | ggtcaaggtactctg | Predicted splice donor site |
| 695 | gaggacagtaagcgg | Predicted splice donor site |
| 696 | ggtcaaggtactctg | Predicted splice donor site |
| 697 | tgcctccgtgtctgc | Predicted splice donor site |
| 698 | caccaaggtgaccgt | Predicted splice donor site |
| 699 | tgaactggtatcagc | Predicted splice donor site |
| 700 | atctcttgaaatggt | Predicted splice donor site |
| 701 | ggccagggcacactg | Predicted splice donor site |
| 702 | gaggacagcaagagg | Predicted splice donor site |
| 703 | ggccagggaaccctg | Predicted splice donor site |
| 704 | tgccagcgttagtgc | Predicted splice donor site |
| 705 | aatctaagtacggac | Predicted splice donor site |
| 706 | tcaactggtacgtgg | Predicted splice donor site |
| 707 | acaattagtaaggca | Predicted splice donor site |
| 708 | accacaggtgtatac | Predicted splice donor site |
| 709 | tttccaggtccgccg | Predicted splice donor site |
| 710 | ctgctctgtgagtta | Predicted splice donor site |
| 711 | acgcaaagtgtgtaa | Predicted splice donor site |
| 712 | caacatggtcagttt | Predicted splice donor site |
| 713 | aacagaggtgaaaac | Predicted splice donor site |
| 714 | ctggagggtgagcca | Predicted splice donor site |
| 715 | gaggtgcagctggtggagtccggaggaggcctggtgaagccaggaggctccctgaggctgtc ttgcgcagccagcggcttcacctttagcgactactatatgtcctggatcagacaggcacctg gcaagggcctggagtgggtgagctcatcatcagctcctctggctccacaatctactatgccgac tctgtgaagggccggtttaccatcagcagagataacgccaagaattccctgtatctgcagat gaacagcctgagggccgaggacacagccgtgtactattgcgccaaggtggacggcgattaca ccgaggattattgggccagggcacactggtgaccgtgagctccggcggcggcggctctgga ggaggaggcagcggcggaggaggctcccagtctgccctgacacagccagccagcgtgtccgg ctctcccggacagtccatcacaatctcttgtaccggctctagctccgacgtgggcaagtaca acctggtgtcctggtatcagcagcccctggcaaggcccctaagctgatcatctacgatgtg aacaagaggccatctggcgtgagcaatcgcttcagcggctccaagtctggcaataccgccac actgaccatcagcggcctgcagggcgacgatgaggcagattactattgttctagctacggcg gcagcagatcctacgtgttcggcacaggcaccaaggtgaccgtgctg | BCMA-23 scFv (nt) |
| 716 | gaggtgcagctggtgcagagcggaggaggcctggtgcagcctggcaggtccctgcgcctgtc ttgcaccgccagcggcttcacatttggcgactatgccatgtcctggttcaggcaggcaccag gcaagggcctggagtgggtgggtcttatccgctctaaggcctacggcggcaccacagagtat gccgccagcgtgaagggccggttcaccatcagccgggacgactctaagagcatcgcctacct gcagatgaactctctgaagaccgaggacacagccgtgtactattgcgcagcatggagcgccc caaccgattattgggccagggcaccctggtgacagtgagctccggcggcggcggctctgga ggaggaagcggaggaggaggatccgacatccagatgacacagtcccctgcctttctgtc cgcctctgtgggcgataggtgaccgtgacatgtcgcgcctcccagggcatctctaactacc tggcctggtatcagcagaagcccggcaatgcccctcggctgctgatctacagcgcctccacc ctgcagagcggagtgccctcccggttcagaggaaccggctatggcacagagttttctctgac catcgacgccctgcagccagaggatttcgccacatactattgtcagcagtcttacaccagcc ggcagacatttggccccggcacaagactggatatcaag | BCMA-25 scFV(nt) |

| SEQ ID NO | SEQUENCE | Description |
|---|---|---|
| 717 | gaggtgcagctggtgcagagcggaggaggcctggtgcagcctggcaggtccctgcgcctgtc ttgcaccgccagcggcttcacatttggcgactatgccatgtcctggttcaagcaggcaccag gcaagggcctggagtgggtgggctttatccgctctaaggcctacggcggcaccacagagtat gccgccagcgtgaagggccggttcaccatcagccgggacgactctaagagcatcgcctacct gcagatgaactctctgaagaccgaggacacagccgtgtactattgcgcagcatggagcgccc aaccgattattggggccagggcaccctggtgacagtgagctccggcggcggcggctctgga ggaggaggaagcggaggaggaggatccgacatccagatgacacagtccctgccttttctgtc cgcctctgtgggcgatagggtgaccgtgacatgtcgcgcctcccagggcatctctaactacc tggcctggtatcagcagaagcccggcaatgccctcggctgctgatctacagcgcctccacc ctgcagagcggagtgccctcccggttcagaggaaccggctatggcacagagttttctctgac catcgacagcctgcagccagaggatttcgccacatactattgtcagcagtcttacaccagcc ggcagacatttggccccggcacaagactggatatcaag | BCMA-25 scFV(nt) (O/SSE) |
| 718 | gaggtgcagctggtggagtccggaggaggcctggtgaagccaggaggctctctgaggctgag ctgcgcagcctccggcttcacctttctgactactatatgagctggatcaggcaggcaccag gcaagggcctggagtgggtgtcttacatcagctcctctggcacaatctactatgccgac tccgtgaagggcaggttcaccatctctcgcgataacgccaagaatagcctgtatctgcagat gaactccctgcgggccgaggatacagccgtgtactattgcgccaaggtggacggccccctt cctttgatatctggggccagggcacaatggtgaccgtgagctccggaggaggaggatccggc ggaggaggctctggcggcggcggctctagctatgtgctgacccagccaccatccgtgtctgt ggcacctggacagacagcaaggatcacctgtggagcaaacaatatcggcagcaagtccgtgc actggtaccagcagaagcctggccaggccccaatgctggtggtgtatgacgatgacgatcgg cccagcggcatccctgagagattttctggcagcaactccggcaataccgccacactgaccat ctctggagtggaggcaggcgacgaggcagattacttctgtcacctgtgggaccggagcagag atcactacgtgttcggcacaggcaccaagctgaccgtgctg | BCMA-26 scFV(nt) |
| 719 | gaggtgcagctggtggagtccggaggaggcctggtgaagccaggaggctctctgaggctgag ctgcgcagcctccggcttcacctttctgactactatatgagctggatcaggcaggcaccag gcaagggcctggagtgggtgtcttacatcagctcctctggcacaatctactatgccgac tccgtgaagggcaggttcaccatctctcgcgataacgccaagaatagcctgtatctgcagat gaactccctgcgggccgaggatacagccgtgtactattgcgccaaggtggacggccccctt cctttgatatctggggccagggcacaatggtgaccgtgagctccggaggaggaggatccggc ggaggaggctctggcggcggcggctctagctatgtgctgacccagccaccatccgtgtctgt ggcacctggacagacagcaaggatcacctgtggagcaaacaatatcggcagcaagtccgtgc actggtaccagcagaagcctggccaggccccaatgctggtggtgtatgacgatgacgatcgg cccagcggcatccctgagagattttctggcagcaactccggcaataccgccacactgaccat ctctggagtggaggcaggcgacgaggcagattacttctgtcacctgtgggaccggagcagag atcactacgtgttcggcacaggcaccaagctgaccgtgctg | BCMA-26 scFV(nt) (O/SSE) |
| 720 | tcttcatgtgagcgg | truncated marker predicted splice donor site |
| 721 | tggctccgccttttcccgagggtgggggagaaccgtatat | promoter predicted splice acceptor site |
| 722 | tgaactgcgtccgccgtctaggtaagtttaaagctcaggtc | promoter predicted splice acceptor site |
| 723 | ttctgttctgcgccgttacagatccaagctgtgaccggcgc | promoter predicted splice acceptor site |
| 724 | ctactacatgagctggatccgccaggctccagggaaggggc | BCMA-23 predicted splice acceptor site |
| 725 | ggctgattattattgtagctcatatggaggtagtaggtctt | BCMA-23 predicted splice acceptor site |
| 726 | ctatgccatgtcctggttcaggcaggcaccaggcaagggcc | BCMA-25 predicted splice acceptor site |
| 727 | gtccgcctctgtgggcgatagggtgaccgtgacatgtcgcg | BCMA-25 predicted splice acceptor site |
| 728 | gtgggctttatccgctctaaggcctacggcggcaccacaga | BCMA-25 predicted splice acceptor site |
| 729 | gtgacatgtcgcgcctcccagggcatctctaactacctggc | BCMA-25 predicted splice acceptor site |
| 730 | tacagcgcctccaccctgcagagcggagtgccctcccggtt | BCMA-25 predicted splice acceptor site |

-continued

| SEQ ID NO | SEQUENCE | Description |
|---|---|---|
| 731 | ctggccatcagtggcctccagtctgaggatgaggctgatta | BCMA-52 predicted splice acceptor site |
| 732 | agatacagcccgtccttccaaggccacgtcaccatctcagc | BCMA-52 predicted splice acceptor site |
| 733 | cgaggctgattattactgcagctcaaatacaagaagcagca | BCMA-55 predicted splice acceptor site |
| 734 | gccctcaggggtttctaatcgcttctctggctccaagtctg | BCMA-55 predicted splice acceptor site |
| 735 | ctactatatgtcctggatcagacaggcacctggcaagggcc | BCMA-23 predicted splice acceptor site (O/SSE) |
| 736 | ggcagattactattgttctagctacggcggcagcagatcct | BCMA-23 predicted splice acceptor site (O/SSE) |
| 737 | ctatgccatgtcctggttcaagcaggcaccaggcaagggcc | BCMA-25 predicted splice acceptor site (O/SSE) |
| 738 | ctggctatttctggactgcagagcgaggacgaggccgacta | BCMA-52 predicted splice acceptor site (O/SSE) |
| 739 | agatacagccctagctttcagggccacgtgaccatcagcgc | BCMA-52 predicted splice acceptor site (O/SSE) |
| 740 | cgaggccgattactactgcagcagcaacacccggtccagca | BCMA-55 predicted splice acceptor site (O/SSE) |
| 741 | gcccagcggcgtgtccaatagattcagcggcagcaagagcg | BCMA-55 predicted splice acceptor site (O/SSE) |
| 742 | aagtttctttctgtattccaggctgaccgtggataaatctc | spacer predicted splice acceptor site |
| 743 | gggcaacgtgttctcttgcagtgtcatgcacgaagccctgc | spacer predicted splice acceptor site |
| 744 | aggggtgctggcctgttacagcctgctggtgacagtcgctt | CD28TM predicted splice acceptor site |
| 745 | gctgagagtcaagttttccaggtccgccgacgctccagcct | 4-1BB/CD3 zeta predicted splice acceptor site |
| 746 | actcctcctctggatccacaggaactggatattctgaaaac | truncated marker predicted splice acceptor site |
| 747 | acagggttttgctgattcaggcttggcctgaaaacaggac | truncated marker predicted splice acceptor site |
| 748 | atggtcagttttctcttgcagtcgtcagcctgaacataaca | truncated marker predicted splice acceptor site |
| 749 | ASTKGPSVFPLAPCSRSTSESTAALGCLVKDYFPEPVTVSWNSGALTSGVHTFPAVLQSSGL YSLSSVVTVPSSNFGTQTYTCNVDHKPSNTKVDKTVERKCCVECPPCPAPPVAGPSVFLFPP KPKDTLMISRTPEVTCVVVDVSHEDPEVQFNWYVDGVEVHNAKTKPREEQFNSTFRVVSVLT VVHQDWLNGKEYKCKVSNKGLPAPIEKTISKTKGQPREPQVYTLPPSREEMTKNQVSLTCLV KGFYPSDISVEWESNGQPENNYKTTPPMLDSDGSFFLYSKLTVDKSRWQQGNVFSCSVMHEA LHNHYTQKSLSLSPGK | Human IgG2 Fc (Uniprot P01859) |

| SEQ ID NO | SEQUENCE | Description |
|---|---|---|
| 750 | ASTKGPSVFPLAPCSRSTSESTAALGCLVKDYFPEPVTVSWNSGALTSGVHTFPAVLQSSGL YSLSSVVTVPSSSLGTKTYTCNVDHKPSNTKVDKRVESKYGPPCPSCPAPEFLGGPSVFLFP PKPKDTLMISRTPEVTCVVVDVSQEDPEVQFNWYVDGVEVHNAKTKPREEQFNSTYRVVSVL TVLHQDWLNGKEYKCKVSNKGLPSSIEKTISKAKGQPREPQVYTLPPSQEEMTKNQVSLTCL VKGFYPSDIAVEWESNGQPENNYKTTPPVLDSDGSFFLYSRLTVDKSRWQEGNVFSCSVMHE ALHNHYTQKSLSLSLGK | Human IgG4 Fc (Uniprot P01861) |
| 751 | gaggtgcagctggtggagtccggaggaggcctggtgaagccaggaggctccctgaggctgtc ttgcgcagccagcggcttcacctttagcgactactatatgtcctggatcagacaggcacctg gcaagggcctggagtgggtgagctacatcagctcctctggctccacaatctactatgccgac tctgtgaagggccggtttaccatcagcagagataacgccaagaattccctgtatctgcagat gaacagcctgagggccgaggacacagccgtgtactattgcgccaaggtggacggcgcatacc cgaggattattggggccagggcacactggtgaccgtgagctccggcggcggcggctctgga ggaggaggcagcggcggaggaggctcccagtctgccctgacacagccagcagcgtgtccgg ctctcccggacagtccatcacaatctcttgtaccggctctagctccgacgtgggcaagtaca accggtgtcctggtatcagcagccccctggcaaggccccctaagctgatcatctacgatgtg aacaagaggccatctggcgtgagcaatcgcttcagcggctccaagtctggcaataccgccac actgaccatcagcggcctgcaggcgacgatgaggcagattactattgttctagctacggcg gcagcagatcctacgtgttcggcacaggcaccaaggtgaccgtgctggaatctaagtacgga ccgccttgtcctccttgtcccgctcctcctgttgccggaccttccgtgttcctgtttcctcc aaagcctaaggacacccctgatgatcagcaggacccctgaagtgacctgcgtggtggtggatg tgtcccaagaggatcccgaggtgcagttcaactggtatgtggacggcgtggaagtgcacaac gccaagaccaagcctagagaggaacagttccagagcacctacagagtggtgtccgtgctgac agtgctgcaccaggattggctgaacggcaaagagtacaagtgcaaggtgtccaacaagggcc tgcctagcagcatcgagaaaaccatctccaaggccaagggccagccaagagagccccaggtt tacacactgcctccaagccaagaggaaatgaccaagaatcaggtgtccctgacatgcctggt caagggcttctaccctccgatatcgccgtggaatgggagagcaatggccagcctgagaaca actacaagaccacacctcctgtgctggacagcgacggcagtttcttcctgtatagtagactc accgtggataaatcaagatggcaagagggcaacgtgttcagctgcagcgtgatgcacgaggc cctgcacaaccactacacccagaaaagcctgagcctgtctctgggcaagatgttctgggtgc tcgtggtcgttggcggagtgctggcctgttacagcctgctggttaccgtggccttcatcatc tttgggtcaagcggggcagaaagaagctgctctacatcttcaagcagcccttcatgcggcc cgtgcagaccacacaagaggaagatggctgctcctgcagattccccgaggaagaagaaggcg gctgcgagctgagagtgaagttcagcagatcgccgacgctccagcctatcagcagggccaa aaccagctgtacaacgagctgaacctggggagaagagaagagtacgacgtgctggataagcg gagaggcagagatcctgaaatgggcggcaagcccagacggaagaatcctcaagagggcctgt ataatgagctgcagaaagacaagatggccgaggcctacagcgagatcggaatgaagggcgag cgcagaagaggcaagggcacgatggactgtaccagggcctgagcaccgccaccaaggatac ctatgacgcactgcacatgcaggccctgccacctaga | anti-BMCA CAR |
| 752 | gaggtgcagctggtgcagagcggaggaggcctggtgcagcctggcaggtccctgcgcctgtc ttgcaccgccagcggcttcacatttggcgactatgccatgtcctggttcaagcaggcaccag gcaagggcctggagtgggtgggctttatccgctctaaggcctacggcggcaccacagagtat gccgccagcgtgaagggccggttcaccatcagccgggacgactctaagagcatcgcctacct gcagatgaactctctgaagaccgaggacacagccgtgtactattgcgcagcatggagcgccc caaccgattattggggccagggcaccctggtgacagtgagctccggcggcggcggctctgga ggaggaggaagcggaggaggaggatccgacatccagatgacacagtcccctgcctttctgtc cgcctctgtgggcgatagggtgaccgtgacatgtcgcgcctcccagggcatctctaactacc tggcctggtatcagcagaagcccggcaatgcccctcggctgctgatctacagcgcctccacc ctgcagagcggagtgccctcccggttcagaggaaccggctatggcacagagtttttctctgac catcgacagcctgcagccagaggatttcgccacatactattgtcagcagtcttacaccagcc ggcagacatttggccccggcacaagactggatatcaaggagtctaaatacggaccgccttgt cctccttgtcccgctcctcctgttgccggaccttccgtgttcctgtttcctccaaagcctaa ggacacccctgatgatcagcaggacccctgaagtgacctgcgtggtggtggatgtgtcccaag aggatcccgaggtgcagttcaactggtatggacggcgtggaagtgcacaacgccaagacc aagcctagagaggaacagttccagagcacctacagagtggtgtccgtgctgacagtgctgca ccaggattggctgaacggcaaagagtacaagtgcaaggtgtccaacaagggcctgcctagca gcatcgagaaaaccatctccaaggccaagggccagccaagagagccccaggtttacacactg cctccaagccaagaggaaatgaccaagaatcaggtgtccctgacatgcctggtcaagggctt ctaccctccgatatcgccgtggaatgggagagcaatggccagcctgagaacaactacaaga ccacacctcctgtgctggacagcgacggcagtttcttcctgtatagtagactcaccgtggat aaatcaagatggcaagagggcaacgtgttcagctgcagcgtgatgcacgaggccctgcacaa ccactacacccagaaaagcctgagcctgtctctgggcaagatgttctgggtgctcgtcgtcg ttggcggagtgctggcctgttacagcctgctggttaccgtggccttcatcatctttgggtc aagcggggcagaaagaagctgctctacatcttcaagcagcccttcatgcggcccgtgcagac cacacaagaggaagatggctgctcctgcagattccccgaggaagaagaaggcggctgcgagc tgagagtgaagttcagcagatcgccgacgctccagcctatcagcagggccaaaaccagctg tacaacgagctgaacctggggagaagagaagagtacgacgtgctggataagcggagaggc agatcctgaaatgggcggcaagcccagacggaagaatcctcaagagggcctgtataatgagc tgcagaaagacaagatggccgaggcctacagcgagatcggaatgaagggcgagcgcagaaga ggcaagggcacgatggactgtaccagggcctgagcaccgccaccaaggatacctatgacgc actgcacatgcaggccctgccacctaga | anti-BMCA CAR |

| SEQ ID NO | SEQUENCE | Description |
|---|---|---|
| 753 | gaggtgcagctggtggagtccggaggaggcctggtgaagccaggaggctctctgaggctgag ctgcgcagcctccggcttcacctttctgactactatatgagctggatcaggcaggcaccag gcaagggcctggagtgggtgtcttacatcagctcctctggcagcacaatctactatgccgac tccgtgaagggcaggttcaccatctctcgcgataacgccaagaatagcctgtatctgcagat gaactccctgcgggccgaggatacagccgtgtactattgcgccaaggtggacggcccccctt cctttgatatctggggccagggcacaatggtgaccgtgagctccggaggaggaggatccggc ggaggaggctctggcggcggcggctctagctatgtgctgacccagccaccatccgtgtctgt ggcacctggacagacagcaaggatcacctgtgtggagcaaacaatatcggcagcaagtccgtgc actggtaccagcagaagcctggccaggcccaatgctggtggtgtatgacgatgacgatcgg cccagcggcatccctgagagattttctggcagcaactccggcaataccgccacactgaccat ctctggagtggaggcaggcgacgaggcagattacttctgtcacctgtgggaccggagcagag atcactacgtgttcggcacaggcaccaagctgaccgtgctggaatctaagtacggaccgcct tgtcctccttgtcccgctcctcctgttgccggaccttccgtgttcctgtttcctccaaagcc taaggacaccctgatgatcagcaggacccctgaagtgacctgcgtggtggtggatgtgtccc aagaggatcccgaggtgcagttcaactggtatgtggacggcgtggaagtgcacaacgccaag accaagcctagagaggaacagttccagagcacctacagagtggtgtccgtgctgacagtgct gcaccaggattggctgaacggcaaagagtacaagtgcaaggtgtccaacaagggcctgccta gcagcatcgagaaaccatctccaaggccaagggccagccaagagagcccccaggtttacaca ctgcctccaagccaagaggaaatgaccaagaatcaggtgtccctgacatgcctggtcaaggg cttctacccctccgatatcgccgtggaatgggagagcaatgccagcctgagaacaactaca agaccacacctcctgtgctggacagcgacggcagtttcttcctgtatagtagactcaccgtg gataaatcaagatggcaagagggcaacgtgttcagctgcagcgtgatgcacgaggccctgca caaccactacacccagaaaagcctgagcctgtctctgggcaagatgttctgggtgctcgtgg tcgttggcggagtgctggcctgttacagcctgctggttaccgtggccttcatcatcttttgg gtcaagcggggcagaaagaagctgctctacatcttcaagcagcccttcatgcggcccgtgca gaccacacaagaggaagatggctgctcctgcagattccccgaggaagaagaaggcggctgcg agctgagagtgaagttcagcagatccgccgacgctccagcctatcagcagggccaaaaccag ctgtacaacgagctgaacctggggagaagagaagagtacgacgtgctggataagcggagagg cagagatcctgaaatgggcggcaagcccagacggaagaatcctcaagagggcctgtataatg agctgcagaaagacaagtggccgaggcctacagcgagatcggaatgaagggcgagcgcaga agaggcaagggacacgatggactgtaccagggcctgagcaccgccaccaaggatacctatga cgcactgcacatgcaggccctgccacctaga | anti-BMCA CAR |
| 754 | agctatgagctgacacagcctccaagcgcctctggcacacctggacagcgagtgacaatgag ctgtagcggcaccagcagcaacatcggcagccacagcgtgaactggtatcagcagctgcctg gcacagcccctaaactgctgatctacaccaacaaccagcggcctagcggcgtgcccgataga ttttctggcagcaagagcggcacaagcgccagcctggctatttcggactgcagagcgagga cgaggccgactattattgtgccgcctgggacggctctctgaacggccttgttttggcggag gcaccaagctgacagtgctgggatctagaggtggcggaggatctggcggcggaggaagcgga ggcggcggatctcttgaaatggctgaagtgcagctggtgcagtctggcgccgaagtgaagaa gcctggcgagagcctgaagatcagctgcaaaggcagcggctacagcttcaccagctactgga tcggctgggtccgacagatgcctggcaaaggccttgagtggatgggcatcatctaccccggc gacagcgacaccgatacagccctagcttttcagggccacgtgaccatcagcgccgacaagtc tatcagcaccgcctacctgcagtggtccagcctgaaggcctctgacaccgccatgtactact gcgccagatactctggcagcttcgacaattgggggccagggcacactggtcaccgtgtccagc gagtctaaatacggaccgccttgtcctccttgtcccgctcctcctgttgccggaccttccgt gttcctgtttcctccaaagcctaaggacaccctgatgatcagcaggacccctgaagtgacct gcgtggtggtggatgtgtcccaagaggatcccgaggtgcagttcaactggtatgtggacggc gtggaagtgcacaacgccaagaccaagcctagagaggaacagttccagagcacctacagagt ggtgtccgtgctgacagtgctgcaccaggattggctgaacggcaaagagtacaagtgcaagg tgtccaacaagggcctgcctagcagcatcgagaaaccatctccaaggccaagggccagcca agagagcccccaggtttacacactgcctccaagccaagaggaaatgaccaagaatcaggtgtc cctgacatgcctggtcaagggcttctacccctccgatatcgccgtggaatgggagagcaatg ccagcctgagaacaactacaagaccacacctcctgtgctggacagcgacggcagtttcttc ctgtatagtagactcaccgtggataaatcaagatggcaagagggcaacgtgttcagctgcag cgtgatgcacgaggccctgcacaaccactacacccagaaaagcctgagcctgtctctgggca agatgttctgggtgctcgtggtcgttggcggagtgctggcctgttacagcctgctggttacc gtggccttcatcatcttttgggtcaagcggggcagaaagaagctgctctacatcttcaagca gcccttcatgcggcccgtgcagaccacacaagaggaagatggctgctcctgcagattcccg aggaagaagaaggcggctgcgagctgagagtgaagttcagcagatccgccgacgctccagcc tatcagcagggccaaaaccagctgtacaacgagctgaacctggggagaagagaagagtacga cgtgctggataagcggagaggcagagatcctgaaatgggcggcaagcccagacggaagaatc ctcaagagggcctgtataatgagctgcagaaagacaagtggccgaggcctacagcgagatc ggaatgaagggcgagcgcagaagaggcaagggacacgatggactgtaccagggcctgagcac cgccaccaaggatacctatgacgcactgcacatgcaggccctgccacctaga | anti-BMCA CAR |
| 755 | cagtctgccctgacacagcctgccagcgttagtgctagtcccggacagtctatcgccatcag ctgtaccggcaccagctctgacgttggctggtatcagcagcaccctggcaaggccctaagc tgatgatctacgaggacagcaagagggcccagcgcgcgtgtccaatagattcagcggcagcaag agcggcaacaccgccagcctgacaattagcggactgcaggccgaggacgaggccgattacta ctgcagcagcaacacccgggtccagcacactggttttttggcggaggcaccaagctgacagtgc tgggatctagaggtggcggaggatctggcggcggaggaagcggaggcggcggatctcttgaa atggctgaagtgcagctggtgcagtctggcgccgagatgaagaaacctggcgcctctctgaa | anti-BMCA CAR |

-continued

| SEQ ID NO | SEQUENCE | Description |
|---|---|---|
| | gctgagctgcaaggccagcggctacaccttcatcgactactacgtgtactggatgcggcagg ccccctggacagggactcgaatctatgggctggatcaaccccaatagcggcggcaccaattac gcccagaaattccagggcagagtgaccatgaccagagacaccagcatcagcaccgcctacat ggaactgagccggctgagatccgacgacaccgccatgtactactgcgccagatctcagcgcg acggctacatggattattgggccagggaaccctggtcaccgtgtccagcgagtctaaatac ggaccgccttgtcctccttgtcccgctcctcctgttgccggaccttccgtgttcctgtttcc tccaaagcctaaggacaccctgatgatcagcaggaccctgaagtgacctgcgtggtggtgg atgtgtcccaagaggatcccgaggtgcagttcaactggtatgtggacggcgtggaagtgcac aacgccaagaccaagcctagagaggaacagttccagagcacctacagagtggtgtccgtgct gacagtgctgcaccaggattggctgaacggcaaagagtacaagtgcaaggtgtccaacaagg gcctgcctagcagcatcgagaaaaccatctccaaggccaagggccagcaagagagccccag gtttacacactgcctccaagccaagaggaaatgaccaagaatcaggtgtccctgacatgcct ggtcaagggcttctacccctccgatatcgccgtggaatgggagagcaatggccagcctgaga caactacaagaccacacctcctgtgctggacagcgacggcagtttcttcctgtatagtaga ctcaccgtggataaatcaagatggcaagagggcaacgtgttcagctgcagcgtgatgcacga ggccctgcacaactactacacccagaaaagcctgagcctgtctctgggcaagatgttctggg tgctcgtggtcgttggcggagtgctggcctgttacagcctgctggttaccgtggccttcatc atcttttgggtcaagcggggcagaaagaagctgctctacatcttcaagcagcccttcatgcg gcccgtgcagaccacacaagaggaagatggctgctcctgcagattcccgaggaagaagaag gcggctgcgagctgagagtgaagttcagcagatccgccgacgctccagcctatcagcagggc caaaaccagctgtacaacgagctgaacctggggagaagaagagtacgacgtgctggataa gcggagaggcagagatcctgaaatgggcggcaagcccagacggaagaatcctcaagagggcc tgtataatgagctgcagaaagacaagatggccgaggcctacagcgagatcggaatgaagggc gagcgcagaagaggcaagggacacgatggactgtaccagggcctgagcaccgccaccaagga tacctatgacgcactgcacatgcaggccctgccacctaga | |
| 756 | cagtctgccctgacacagcctgccagcgttagtgctagtcccggacagtctatcgccatcag ctgtaccggcaccagctctgacgttggctggtatcagcagcaccctggcaaggcccctaagc tgatgatctacgaggacagcaagaggcccagcggcgtgtccaatagattcagcggcagcaag agcggcaacaccgccagcctgacaattagcggactgcaggccgaggacgaggccgattacta ctgcagcagcaacacccggtccagcacactggtttttggcggaggcaccaagctgacagtgc tgggatctagaggtggcggaggatctggcggcggaggaagcggaggcggcggatctcttgaa atggctgaagtgcagctggtgcagtctggcgccgagatgaagaaacctggcgcctctctgaa gctgagctgcaaggccagcggctacaccttcatcgactactacgtgtactggatgcggcagg ccccctggacagggactcgaatctatgggctggatcaaccccaatagcggcggcaccaattac gcccagaaattccagggcagagtgaccatgaccagagacaccagcatcagcaccgcctacat ggaactgagccggctgagatccgacgacaccgccatgtactactgcgccagatctcagcgcg acggctacatggattattgggccagggaaccctggtcaccgtgtccagcgagtctaaatac ggaccgccttgtcctccttgtcccgctcctcctgttgccggaccttccgtgttcctgtttcc tccaaagcctaaggacaccctgatgatcagcaggaccctgaagtgacctgcgtggtggtgg atgtgtcccaagaggatcccgaggtgcagttcaactggtatgtggacggcgtggaagtgcac aacgccaagaccaagcctagagaggaacagttccagagcacctacagagtggtgtccgtgct gacagtgctgcaccaggattggctgaacggcaaagagtacaagtgcaaggtgtccaacaagg gcctgcctagcagcatcgagaaaaccatctccaaggccaagggccagcaagagagccccag gtttacacactgcctccaagccaagaggaaatgaccaagaatcaggtgtccctgacatgcct ggtcaagggcttctacccctccgatatcgccgtggaatgggagagcaatggccagcctgaga caactacaagaccacacctcctgtgctggacagcgacggcagtttcttcctgtatagtaga ctcaccgtggataaatcaagatggcaagagggcaacgtgttcagctgcagcgtgatgcacga ggccctgcacaactactacacccagaaaagcctgagcctgtctctgggcaagatgttctggg tgctcgtggtcgttggcggagtgctggcctgttacagcctgctggttaccgtggccttcatc atcttttgggtcaggagtaagaggagcaggctcctgcacagtgactacatgaacatgactcc ccgccgccccgggcccacccgcaagcattaccagccctatgccccaccacgcgacttcgcag cctatcgctccagagtgaagttcagcagatccgccgacgctccagcctatcagcagggccaa aaccagctgtacaacgagctgaacctggggagaagaagagtacgacgtgctggataagcgg agagggcagagatcctgaaatgggcggcaagcccagacggaagaatcctcaagagggcctgt ataatgagctgcagaaagacaagatggccgaggcctacagcgagatcggaatgaagggcgag cgcagaagaggcaagggacacgatggactgtaccagggcctgagcaccgccaccaaggatac ctatgacgcactgcacatgcaggccctgccacctaga | anti-BMCA CAR |
| 757 | EVQLVESGGGLVKPGGSLRLSCAASGFTFSDYYMSWIRQAPGKGLEWVSYISSSGSTIYYAD SVKGRFTISRDNAKNSLYLQMNSLRAEDTAVYYCAKVDGDYTEDYWGQGTLVTVSSGGGGSG GGGSGGGGSQSALTQPASVSGSPGQSITISCTGSSSDVGKYNLVSWYQQPPGKAPKLIIYDV NKRPSGVSNRFSGSKSGNTATLTISGLQDDEADYYCSSYGGRSYVFGTGTKVTVLESKYG PPCPPCPAPPVAGPSVFLFPPKPKDTLMISRTPEVTCVVVDVSQEDPEVQFNWYVDGVEVHN AKTKPREEQFQSTYRVVSVLTVLHQDWLNGKEYKCKVSNKGLPSSIEKTISKAKGQPREPQV YTLPPSQEEMTKNQVSLTCLVKGFYPSDIAVEWESNGQPENNYKTTPPVLDSDGSFFLYSRL TVDKSRWQEGNVFSCSVMHEALHNHYTQKSLSLSLGKMFWVLVVVGGVLACYSLLVTVAFII FWVKRGRKKLLYIFKQPFMRPVQTTQEEDGCSCRFPEEEEGGCELRVKFSRSADAPAYQQGQ NQLYNELNLGRREEYDVLDKRRGRDPEMGGKPRRKNPQEGLYNELQKDKMAEAYSEIGMKGE RRRGKGHDGLYQGLSTATKDTYDALHMQALPPR | anti-BMCA CAR |
| 758 | EVQLVQSGGGLVQPGRSLRLSCTASGFTFGDYAMSWFKQAPGKGLEWVGFIRSKAYGGTTEY AASVKGRFTISRDDSKSIAYLQMNSLKTEDTAVYYCAAWSAPTDYWGQGTLVTVSSGGGGSG | anti-BMCA CAR |

-continued

| SEQ ID NO | SEQUENCE | Description |
|---|---|---|
| | GGGSGGGGSDIQMTQSPAFLSASVGDRVTVTCRASQGISNYLAWYQQKPGNAPRLLIYSAST<br>LQSGVPSRFRGTGYGTEFSLTIDSLQPEDFATYYCQQSYTSRQTFGPGTRLDIKESKYGPPC<br>PPCPAPPVAGPSVFLFPPKPKDTLMISRTPEVTCVVVDVSQEDPEVQFNWYVDGVEVHNAKT<br>KPREEQFQSTYRVVSVLTVLHQDWLNGKEYKCKVSNKGLPSSIEKTISKAKGQPREPQVYTL<br>PPSQEEMTKNQVSLTCLVKGFYPSDIAVEWESNGQPENNYKTTPPVLDSDGSFFLYSRLTVD<br>KSRWQEGNVFSCSVMHEALHNHYTQKSLSLSLGKMFWVLVVVGGVLACYSLLVTVAFIIFWV<br>KRGRKKLLYIFKQPFMRPVQTTQEEDGCSCRFPEEEEGGCELRVKFSRSADAPAYQQGQNQL<br>YNELNLGRREEYDVLDKRRGRDPEMGGKPRRKNPQEGLYNELQKDKMAEAYSEIGMKGERRR<br>GKGHDGLYQGLSTATKDTYDALHMQALPPR | |
| 759 | EVQLVESGGGLVKPGGSLRLSCAASGFTFSDYYMSWIRQAPGKGLEWVSYISSSGSTIYYAD<br>SVKGRFTISRDNAKNSLYLQMNSLRAEDTAVYYCAKVDGPPSFDIWGQGTMVTVSSGGGGSG<br>GGGSGGGGSSYVLTQPPSVSVAPGQTARITCGANNIGSKSVHWYQQKPGQAPMLVVYDDDDR<br>PSGIPERFSGSNSGNTATLTISGVEAGDEADYFCHLWDRSRDHYVFGTGTKLTVLESKYGPP<br>CPPCPAPPVAGPSVFLFPPKPKDTLMISRTPEVTCVVVDVSQEDPEVQFNWYVDGVEVHNAK<br>TKPREEQFQSTYRVVSVLTVLHQDWLNGKEYKCKVSNKGLPSSIEKTISKAKGQPREPQVYT<br>LPPSQEEMTKNQVSLTCLVKGFYPSDIAVEWESNGQPENNYKTTPPVLDSDGSFFLYSRLTV<br>DKSRWQEGNVFSCSVMHEALHNHYTQKSLSLSLGKMFWVLVVVGGVLACYSLLVTVAFIIFW<br>VKRGRKKLLYIFKQPFMRPVQTTQEEDGCSCRFPEEEEGGCELRVKFSRSADAPAYQQGQNQ<br>LYNELNLGRREEYDVLDKRRGRDPEMGGKPRRKNPQEGLYNELQKDKMAEAYSEIGMKGERR<br>RGKGHDGLYQGLSTATKDTYDALHMQALPPR | anti-BMCA CAR |
| 760 | SYELTQPPSASGTPGQRVTMSCSGTSSNIGSHSVNWYQQLPGTAPKLLIYTNNQRPSGVPDR<br>FSGSKSGTSASLAISGLQSEDEADYYCAAWDGSLNGLVFGGGTKLTVLGSRGGGGSGGGGSG<br>GGGSLEMAEVQLVQSGAEVKKPGESLKISCKGSGYSFTSYWIGWVRQMPGKGLEWMGIIYPG<br>DSDTRYSPSFQGHVTISADKSISSTAYLQWSSLKASDTAMYYCARYSGSFDNWGQGTLVTVS<br>ESKYGPPCPPCPAPPVAGPSVFLFPPKPKDTLMISRTPEVTCVVVDVSQEDPEVQFNWYVDG<br>VEVHNAKTKPREEQFQSTYRVVSVLTVLHQDWLNGKEYKCKVSNKGLPSSIEKTISKAKGQ<br>REPQVYTLPPSQEEMTKNQVSLTCLVKGFYPSDIAVEWESNGQPENNYKTTPPVLDSDGSFF<br>LYSRLTVDKSRWQEGNVFSCSVMHEALHNHYTQKSLSLSLGKMFWVLVVVGGVLACYSLLVT<br>VAFIIFWVKRGRKKLLYIFKQPFMRPVQTTQEEDGCSCRFPEEEEGGCELRVKFSRSADAPA<br>YQQGQNQLYNELNLGRREEYDVLDKRRGRDPEMGGKPRRKNPQEGLYNELQKDKMAEAYSEI<br>GMKGERRRGKGHDGLYQGLSTATKDTYDALHMQALPPR | anti-BMCA CAR |
| 761 | QSALTQPASVSASPGQSIAISCTGTSSDVGWYQQHPGKAPKLMIYEDSKRPSGVSNRFSGSK<br>SGNTASLTISGLQAEDEADYYCSSNTRSSTLVFGGGTKLTVLGSRGGGGSGGGGSGGGGSLE<br>MAEVQLVQSGAEMKKPGASLKLSCKASGYTFIDYYVYWMRQAPGQGLESMGWINPNSGGTNY<br>AQKFQGRVTMTRDTSISTAYMELSRLRSDDTAMYYCARSQRDGYMDYWGQGTLVTVSSESKY<br>GPPCPPCPAPPVAGPSVFLFPPKPKDTLMISRTPEVTCVVVDVSQEDPEVQFNWYVDGVEVH<br>NAKTKPREEQFQSTYRVVSVLTVLHQDWLNGKEYKCKVSNKGLPSSIEKTISKAKGQPREPQ<br>VYTLPPSQEEMTKNQVSLTCLVKGFYPSDIAVEWESNGQPENNYKTTPPVLDSDGSFFLYSR<br>LTVDKSRWQEGNVFSCSVMHEALHNHYTQKSLSLSLGKMFWVLVVVGGVLACYSLLVTVAFI<br>IFWVKRGRKKLLYIFKQPFMRPVQTTQEEDGCSCRFPEEEEGGCELRVKFSRSADAPAYQQG<br>QNQLYNELNLGRREEYDVLDKRRGRDPEMGGKPRRKNPQEGLYNELQKDKMAEAYSEIGMKG<br>ERRRGKGHDGLYQGLSTATKDTYDALHMQALPPR | anti-BMCA CAR |
| 762 | QSALTQPASVSASPGQSIAISCTGTSSDVGWYQQHPGKAPKLMIYEDSKRPSGVSNRFSGSK<br>SGNTASLTISGLQAEDEADYYCSSNTRSSTLVFGGGTKLTVLGSRGGGGSGGGGSGGGGSLE<br>MAEVQLVQSGAEMKKPGASLKLSCKASGYTFIDYYVYWMRQAPGQGLESMGWINPNSGGTNY<br>AQKFQGRVTMTRDTSISTAYMELSRLRSDDTAMYYCARSQRDGYMDYWGQGTLVTVSSESKY<br>GPPCPPCPAPPVAGPSVFLFPPKPKDTLMISRTPEVTCVVVDVSQEDPEVQFNWYVDGVEVH<br>NAKTKPREEQFQSTYRVVSVLTVLHQDWLNGKEYKCKVSNKGLPSSIEKTISKAKGQPREPQ<br>VYTLPPSQEEMTKNQVSLTCLVKGFYPSDIAVEWESNGQPENNYKTTPPVLDSDGSFFLYSR<br>LTVDKSRWQEGNVFSCSVMHEALHNHYTQKSLSLSLGKMFWVLVVVGGVLACYSLLVTVAFI<br>IFWVRSKRSRLLHSDYMNMTPRRPGPTRKHYQPYAPPRDFAAYRSRVKFSRSADAPAYQQGQ<br>NQLYNELNLGRREEYDVLDKRRGRDPEMGGKPRRKNPQEGLYNELQKDKMAEAYSEIGMKGE<br>RRRGKGHDGLYQGLSTATKDTYDALHMQALPPR | anti-BMCA CAR |
| 763 | cttttttcgcaacgggtttgc | EF1a/HTLV promoter forward primer |
| 764 | gatatcgaattcctgcagcc | Reverse primer just 5' of WPRE |
| 765 | cgccttgtcctccttgtccagctcctcctgttgccggacct | predicted splice acceptor site |
| 766 | cgccttgtcctccttgtcccgctcctcctgttgccggacct | optimized splice acceptor site |
| 767 | cagtttcttcctgtatagtagactcaccgtggataaatcaa | predicted splice acceptor site |

| SEQ ID NO | SEQUENCE | Description |
|---|---|---|
| 768 | accggattcctcctgattcaggcctggccagagaacagaac | predicted splice acceptor site |
| 769 | LPVLTQPPSTSGTPGQRVTVSCSGSSSNIGSNVVFWYQQLPGTAPKLVIYRNNQRPSGVPDR FSVSKSGTSASLAISGLRSEDEADYYCAAWDDSLSGYVFGTGTKVTVLGSRGGGGSGGGGS GGGGSLEMAEVQLVQSGAEVKKPGSSVKVSCKASGGTFSSYAISWVRQAPGQGLEWMGRIIPI LGIANYAQKFQGRVTMTEDTSTDTAYMELSSLRSEDTAVYYCARSGYSKSIVSYMDYWGQGT LVTVSS | anti-BMCA scFv |
| 770 | QAVLTQPPSASGTPGQRVTISCSGSSSNIGSNYVFWYQQLPGTAPKLLIYSNNQRPSGVPDR FSGSKSGTSASLAISGLRSEDEADYYCAAWDDSLSASYVFGTGTKVTVLGSRGGGGSGGGGS GGGGSLEMAQVQLVQSGAEVKKPGSSVKVSCKASGGTFSSYAISWVRQAPGQGLEWMGRIIP ILGTANYAQKFQGRVTITADESTSTAYMELSSLRSEDTAVYYCARSGYGSYRWEDSWGQGTL VTVSS | anti-BCMA scFV |
| 771 | QSVLTQPPSVSGAPGQRVTISCTGSSSNIGAGFDVHWYQQLPGTAPKLLIYGNSNRPSGVPD RFSGSKSGTSASLAITGLQAEDEADYYCQSYDSSLSGYVFGTGTKVTVLGSRGGGGSGGGGS GGGGSLEMAQVQLVQSGAEVKKPGASVKVSCKASGYTFTDYYMHWVRQAPGQRLEWMGWINP NSGGTNYAQKFQDRITVTRDTSSNTGYMELTRLRSDDTAVYYCARSPYSGVLDKWGQGTLVT VSS | anti-BCMA scFV |
| 772 | EVQLVQSGAEVKKPGSSVKVSCKASGGTFSSYAISWVRQAPGQGLEWMGRIIPILGIANYAQ KFQGRVTMTEDTSTDTAYMELSSLRSEDTAVYYCARSGYSKSIVSYMDYWGQGTLVTVSS | anti-BMCA VH |
| 773 | QVQLVQSGAEVKKPGSSVKVSCKASGGTFSSYAISWVRQAPGQGLEWMGRIIPILGTANYAQ KFQGRVTITADESTSTAYMELSSLRSEDTAVYYCARSGYGSYRWEDSWGQGTLVTVSS | anti-BMCA VH |
| 774 | QVQLVQSGAEVKKPGASVKVSCKASGYTFTDYYMHWVRQAPGQRLEWMGWINPNSGGTNYAQ KFQDRITVTRDTSSNTGYMELTRLRSDDTAVYYCARSPYSGVLDKWGQGTLVTVSS | anti-BMCA VH |
| 775 | LPVLTQPPSTSGTPGQRVTVSCSGSSSNIGSNVVFWYQQLPGTAPKLVIYRNNQRPSGVPDR FSVSKSGTSASLAISGLRSEDEADYYCAAWDDSLSGYVFGTGTKVTVLG | anti-BCMA VL |
| 776 | QAVLTQPPSASGTPGQRVTISCSGSSSNIGSNYVFWYQQLPGTAPKLLIYSNNQRPSGVPDR FSGSKSGTSASLAISGLRSEDEADYYCAAWDDSLSASYVFGTGTKVTVLG | anti-BMCA VL |
| 777 | QSVLTQPPSVSGAPGQRVTISCTGSSSNIGAGFDVHWYQQLPGTAPKLLIYGNSNRPSGVPD RFSGSKSGTSASLAITGLQAEDEADYYCQSYDSSLSGYVFGTGTKVTVLG | anti-BMCA VL |
| 778 | SRGGGGSGGGGSGGGGSLEMA | linker |
| 779 | YFDSL | BCMA epitope |
| 780 | QNEYFDSLL | BMCA epitope |
| 781 | LPVLTQPPSASGTPGQRVTISCSGRSSNIGSNSVNWYRQLPGAAPKLLIYSNNQRPPGVPVR FSGSKSGTSASLAISGLQSEDEATYYCATWDDNLNVHYVFGTGTKVTVLGSRGGGGSGGGGS GGGGSLEMAQVQLVQSGAEVKKPGSSVKVSCKASGGTFSSYAISWVRQAPGQGLEWMGRIIP ILGIANYAQKFQGRVTITADKSTSTAYMELSSLRSEDTAVYYCARGGYYSHDMWSEDWGQGT LVTVSS | anti-BCMA scFv |
| 782 | EVQLLESGGGLVQPGGSLRLSCAASGFTFSSYAMSWVRQAPGKGLEWVSAISGSGGSTYYAD SVKGRFTISRDNSKNTLYLQMNSLRAEDTAVYYCARAEMGAVFDIWGQGTMVTSSGSTSGS GKPGSGEGSTKGEIVLTQSPATLSLSPGERATLSCRASQSVSRYLAWYQQKPGQAPRLLIYD ASNRATGIPARFSGSGSGTDFTLTISSLEPEDFAVYYCQQRISWPFTFGGGTKVEIK | anti-BCMA scFv |
| 783 | EIVLTQSPATLSLSPGERATLSCRASQSVSRYLAWYQQKPGQAPRLLIYDASNRATGIPARF SGSGSGTDFTLTISSLEPEDFAVYYCQQRISWPFTFGGGTKVEIKRGSTSGSGKPGSGEGST KGEVQLLESGGGLVQPGGSLRLSCAASGFTFSSYAMSWVRQAPGKGLEWVSAISGSGGSTYY ADSVKGRFTISRDNSKNTLYLQMNSLRAEDTAVYYCARAEMGAVFDIWGQGTMVTVSS | anti-BCMA scFv |
| 784 | QVQLVESGGGVVQPGRSLRLSCAASGFTFSSYGMHWVRQAPGKGLEWVAVISYDGSNKYYAD SVKGRFTISRDNSKNTLYLQMNSLRAEDTAVYYCARDGTYLGGLWYFDLWGRGTLVTVSSGS TSGSGKPGSGEGSTKGDIVMTQSPLSLPVTPGEPASISCRSSQSLLHSNGYNYLDWYLQKPG QSPQLLIYLGSNRASGVPDRFSGSGSGTDFTLKISRVEAEDVGVYYCMQGLGLPLTFGGGTK VEIK | anti-BCMA scFv |
| 785 | DIVMTQSPLSLPVTPGEPASISCRSSQSLLHSNGYNYLDWYLQKPGQSPQLLIYLGSNRASG VPDRFSGSGSGTDFTLKISRVEAEDVGVYYCMQGLGLPLTFGGGTKVEIKRGSTSGSGKPGS GEGSTKGQVQLVESGGGVVQPGRSLRLSCAASGFTFSSYGMHWVRQAPGKGLEWVAVISYDG SNKYYADSVKGRFTISRDNSKNTLYLQMNSLRAEDTAVYYCARDGTYLGGLWYFDLWGRGTL VTVSS | anti-BCMA scFv |

-continued

| SEQ ID NO | SEQUENCE | Description |
|---|---|---|
| 786 | QVQLVQSGAEVKKPGASVKVSCKASGYTFTSYYMHWVRQAPGQGLEWMGIINPGGGSTYAQ KFQGRVTMTRDTSTSTVYMELSSLRSEDTAVYYCARESWPMDVWGQGTTVTVSSGSTSGSGK PGSGEGSTKGEIVMTQSPATLSVSPGERATLSCRASQSVSSNLAWYQQKPGQAPRLLIYGAS TRATGIPARFSGSGSGTEFTLTISSLQSEDFAVYYCQQYAAYPTFGGGTKVEIK | anti-BCMA scFv |
| 787 | EIVMTQSPATLSVSPGERATLSCRASQSVSSNLAWYQQKPGQAPRLLIYGASTRATGIPARF SGSGSGTEFTLTISSLQSEDFAVYYCQQYAAYPTFGGGTKVEIKRGSTSGSGKPGSGEGSTK GQVQLVQSGAEVKKPGASVKVSCKASGYTFTSYYMHWVRQAPGQGLEWMGIINPGGGSTSYA QKFQGRVTMTRDTSTSTVYMELSSLRSEDTAVYYCARESWPMDVWGQGTTVTVSS | anti-BCMA scFv |
| 788 | QLQLQESGPGLVKPSETLSLTCTVSGGSISSSSYYWGWIRQPPGKGLEWIGSISYSGSTYYN PSLKSRVTISVDTSKNQFSLKLSSVTAADTAVYYCARGRGYATSLAFDIWGQGTMVTVSSGS TSGSGSGKPGSGEGSTKGEIVLTQSPATLSLSPGERATLSCRASQSVSSYLAWYQQKPGQAPRL LIYDASNRATGIPARFSGSGSGTDFTLTISSLEPEDFAVYYCQQRHVWPPTFGGGTKVEIK | anti-BCMA scFv |
| 789 | EIVLTQSPATLSLSPGERATLSCRASQSVSSYLAWYQQKPGQAPRLLIYDASNRATGIPARF SGSGSGTDFTLTISSLEPEDFAVYYCQQRHVWPPTFGGGTKVEIKRGSTSGSGKPGSGEGST KGQLQLQESGPGLVKPSETLSLTCTVSGGSISSSSYYWGWIRQPPGKGLEWIGSISYSGSTY YNPSLKSRVTISVDTSKNQFSLKLSSVTAADTAVYYCARGRGYATSLAFDIWGQGTMVTVSS | anti-BCMA scFv |
| 790 | EVQLVESGGGLVQPGGSLRLSCAASGFTFSSYSMNWVRQAPGKGLEWVSTISSSSSTIYYAD SVKGRFTISRDNAKNSLYLQMNSLRAEDTAVYYCARGSQEHLIFDYWGQGTLVTVSSGSTSG SGKPGSGEGSTKGEIVLTQSPATLSLSPGERATLSCRASQSVSRYLAWYQQKPGQAPRLLIY DASNRATGIPARFSGSGSGTDFTLTISSLEPEDFAVYYCQQRFYYPWTFGGGTKVEIK | anti-BCMA scFv |
| 791 | EIVLTQSPATLSLSPGERATLSCRASQSVSRYLAWYQQKPGQAPRLLIYDASNRATGIPARF SGSGSGTDFTLTISSLEPEDFAVYYCQQRFYYPWTFGGGTKVEIKRGSTSGSGKPGSGEGST KGEVQLVESGGGLVQPGGSLRLSCAASGFTFSSYSMNWVRQAPGKGLEWVSTISSSSSTIYY ADSVKGRFTISRDNAKNSLYLQMNSLRAEDTAVYYCARGSQEHLIFDYWGQGTLVTVSS | anti-BCMA scFv |
| 792 | QVQLVESGGGVVQPGRSLRLSCAASGFTFSSYGMHWVRQAPGKGLEWVAVISYDGSNKYYAD SVKGRFTISRDNSKNTLYLQMNSLRAEDTAVYYCARTDFWSGSPPGLDYWGQGTLVTVSSGS TSGSGKPGSGEGSTKGDIQLTQSPSSVSASVGDRVTITCRASQGISSWLAWYQQKPGKAPKL LIYGASSLQSGVPSRFSGSGSGTDFTLTISSLQPEDFATYYCQQIYTFPFTFGGGTKVEIK | anti-BCMA scFv |
| 793 | DIQLTQSPSSVSASVGDRVTITCRASQGISSWLAWYQQKPGKAPKLLIYGASSLQSGVPSRF SGSGSGTDFTLTISSLQPEDFATYYCQQIYTFPFTFGGGTKVEIKRGSTSGSGKPGSGEGST KGQVQLVESGGGVVQPGRSLRLSCAASGFTFSSYGMHWVRQAPGKGLEWVAVISYDGSNKYY ADSVKGRFTISRDNSKNTLYLQMNSLRAEDTAVYYCARTDFWSGSPPGLDYWGQGTLVTVSS | anti-BCMA scFv |
| 794 | QVQLVQSGAEVKKPGSSVKVSCKASGGTFSSYAISWVRQAPGQGLEWMGGIIPIFGTANYAQ KFQGRVTITADESTSTAYMELSSLRSEDTAVYYCARTPEYSSSIWHYYYGMDVWGQGTTVTV SSGSTSGSGKPGSGEGSTKGDIVMTQSPDSLAVSLGERATINCKSSQSVLYSSNNKNYLAWY QQKPGQPPKLLIYWASTRESGVPDRFSGSGSGTDFTLTISSLQAEDVAVYYCQQFAHTPFTF GGGTKVEIK | anti-BCMA scFv |
| 795 | DIVMTQSPDSLAVSLGERATINCKSSQSVLYSSNNKNYLAWYQQKPGQPPKLLIYWASTRES GVPDRFSGSGSGTDFTLTISSLQAEDVAVYYCQQFAHTPFTFGGGTKVEIKRGSTSGSGKPG SGEGSTKGQVQLVQSGAEVKKPGSSVKVSCKASGGTFSSYAISWVRQAPGQGLEWMGGIIPI FGTANYAQKFQGRVTITADESTSTAYMELSSLRSEDTAVYYCARTPEYSSSIWHYYYGMDVW GQGTTVTVSS | anti-BCMA scFv |
| 796 | QVQLVESGGGVVQPGRSLRLSCAASGFTFSSYGMHWVRQAPGKGLEWVAVISYDGSNKYYAD SVKGRFTISRDNSKNTLYLQMNSLRAEDTAVYYCVKGPLQEPPYDYGMDVWGQGTTVTVSSG STSGSGKPGSGEGSTKGEIVMTQSPATLSVSPGERATLSCRASQSVSSNLAWYQQKPGQAPR LLIYSASTRATGIPARFSGSGSGTEFTLTISSLQSEDFAVYYCQQHVWPLTFGGGTKVEIK | anti-BCMA scFv |
| 797 | EIVMTQSPATLSVSPGERATLSCRASQSVSSNLAWYQQKPGQAPRLLIYSASTRATGIPARF SGSGSGTEFTLTISSLQSEDFAVYYCQQHVWPLTFGGGTKVEIKRGSTSGSGKPGSGEGST KGQVQLVESGGGVVQPGRSLRLSCAASGFTFSSYGMHWVRQAPGKGLEWVAVISYDGSNKYY ADSVKGRFTISRDNSKNTLYLQMNSLRAEDTAVYYCVKGPLQEPPYDYGMDVWGQGTTVTVS S | anti-BCMA scFv |
| 798 | DIVLTQSPASLAVSLGERATINCRASESVSVIGAHLIHWYQQKPGQPPKLLIYLASNLETGV PARFSGSGSGTDFTLTISSLQAEDAAIYYCLQSRIFPRTFGQGTKLEIKGSTSGSGKPGSGE GSTKGQVQLVQSGSELKKPGASVKVSCKASGYTFTDYSINWVRQAPGQGLEWMGWINTETRE PAYAYDFRGRFVFSLDTSVSTAYLQISSLKAEDTAVYYCARDYSYAMDYWGQGTLVTVSS | anti-BCMA scFv |
| 799 | DIVLTQSPASLAVSLGERATINCRASESVSVIGAHLIHWYQQKPGQPPKLLIYLASNLETGV PARFSGSGSGTDFTLTISSLQAEDAAIYYCLQSRIFPRTFGQGTKLEIKGSTSGSGKPGSGE GSTKGQVQLVQSGSELKKPGASVKVSCKASGYTFTDYSINWVRQAPGQGLEWMGWINTETRE PAYAYDFRGRFVFSLDTSVSTAYLQISSLKAEDTAVYYCARDYSYAMDYWGQGTLVTVSS | anti-BCMA scFv |

| SEQ ID NO | SEQUENCE | Description |
|---|---|---|
| 800 | DIVLTQSPASLAVSLGERATINCRASESVSVIGAHLIHWYQQKPGQPPKLLIYLASNLETGV PARFSGSGSGTDFTLTISSLQAEDAAIYYCLQSRIFPRTFGQGTKLEIKGSTSGSGKPGSGE GSTKGQVQLVQSGSELKKPGASVKVSCKASGYTFTDYSINWVRQAPGQGLEWMGWINTETRE PAYAYDFRGRFVFSLDTSVSTAYLQISSLKAEDTAVYYCARDYSYAMDYWGQGTLVTVSS | anti-BCMA scFv |
| 801 | EVQLVESGGGLVQPGGSLRLSCAVSGFALSNHGMSWVRRAPGKGLEWVSGIVYSGSTYYAAS VKGRFTISRDNSRNTLYLQMNSLRPEDTAIYYCSAHGGESDVWGQGTTVTVSSASGGGGSGG RASGGGGSDIQLTQSPSSLSASVGDRVTITCRASQSISSYLNWYQQKPGKAPKLLIYAASSL QSGVPSRFSGSGSGTDFTLTISSLQPEDFATYYCQQSYSTPYTFGQGTKVEIK | anti-BCMA scFv |
| 802 | QVQLVESGGGLVQPGRSLRLSCAASGFTFSNYAMSWVRQAPGKGLGWVSGISRSGENTYYAD SVKGRFTISRDNSKNTLYLQMNSLRDEDTAVYYCARSPAHYYGGMDVWGQGTTVTVSSASGG GGSGGGGSDIVLTQSPGTLSLSPGERATLSCRASQSISSSFLAWYQQKPGQAPRLLI YGASRRATGIPDRFSGSGSGTDFTLTISRLEPEDSAVYYCQQYHSSPSWTFGQGTKLEIK | anti-BCMA scFv |
| 803 | QVQLVESGGGLVQPGGSLRLSCAVSGFALSNHGMSWVRRAPGKGLEWVSGIVYSGSTYYAAS VKGRFTISRDNSRNTLYLQMNSLRPEDTAIYYCSAHGGESDVWGQGTTVTVSSASGGGGSGG RASGGGGSDIRLTQSPSPLSASVGDRVTITCQASEDINKFLNWYHQTPGKAPKLLIYDASTL QTGVPSRFSGSGSGTDFTLTINSLQPEDIGTYYCQQYESLPLTFGGGTKVEIK | anti-BCMA scFv |
| 804 | EVQLVESGGGLVQPGGSLRLSCAVSGFALSNHGMSWVRRAPGKGLEWVSGIVYSGSTYYAAS VKGRFTISRDNSRNTLYLQMNSLRPEDTAIYYCSAHGGESDVWGQGTTVTVSSASGGGGSGG RASGGGGSEIVLTQSPGTLSLSPGERATLSCRASQSIGSSSLAWYQQKPGQAPRLLMYGASS RASGIPDRFSGSGSGTDFTLTISRLEPEDFAVYYCQQYAGSPPFTFGQGTKVEIK | anti-BCMA scFv |
| 805 | QIQLVQSGPELKKPGETVKISCKASGYTFTDYSINWVKRAPGKGLKWMGWINTETREPAYAY DFRGRFAFSLETSASTAYLQINNLKYEDTATYFCALDYSYAMDYWGQGTSVTVSSGGGGSGG GGSGGGGSDIVLTQSPASLAMSLGKRATISCRASESVSVIGAHLIHWYQQKPGQPPKLLIYL ASNLETGVPARFSGSGSGTDFTLTIDPVEEDDVAIYSCLQSRIFPRTFGGGTKLEIK | anti-BCMA scFv |
| 806 | QIQLVQSGPELKKPGETVKISCKASGYTFRHYSMNWVKQAPGKGLKWMGRINTESGVPIYAD DFKGRFAFSVETSASTAYLVINNLKDEDTASYFCSNDYLYSLDFWGQGTALTVSSGGGGSGG GGSGGGGSDIVLTQSPPSLAMSLGKRATISCRASESVTILGSHLIYWYQQKPGQPPTLLIQL ASNVQTGVPARFSGSGSRTDFTLTIDPVEEDDVAVYYCLQSRTIPRTFGGGTKLEIK | anti-BCMA scFv |
| 807 | QIQLVQSGPELKKPGETVKISCKASGYTFTHYSMNWVKQAPGKGLKWMGRINTETGEPLYAD DFKGRFAFSLETSASTAYLVINNLKNEDTATFFCSNDYLYSCDYWGQGTTLTVSSGGGGSGG GGSGGGGSDIVLTQSPPSLAMSLGKRATISCRASESVTILGSHLIYWYQQKPGQPPTLLIQL ASNVQTGVPARFSGSGSRTDFTLTIDPVEEDDVAVYYCLQSRTIPRTFGGGTKLEIK | anti-BCMA scFv |
| 808 | QVQLVQSGAEVKKPGASVKVSCKASGYSFPDYYINWVRQAPGQGLEWMGWIYFASGNSEYNQ KFTGRVTMTRDTSINTAYMELSSLTSEDTAVYFCASLYDYDWYFDVWGQGTMVTVSSGGGGS GGGGSGGGGSDIVMTQTPLSLSVTPGQPASISCKSSQSLVHSNGNTYLHWYLQKPGQSPQLL IYKVSNRFSGVPDRFSGSGSGTDFTLKISRVEAEDVGIYYCSQSSIYPWTFGQGTKLEIK | anti-BCMA scFv |
| 809 | QVQLVQSGAEVKKPGASVKVSCKASGYSFPDYYINWVRQAPGQGLEWMGWIYFASGNSEYNQ KFTGRVTMTRDTSINTAYMELSSLTSEDTAVYFCASLYDYDWYFDVWGQGTMVTVSSGGGGS GGGGSGGGGSDIVMTQTPLSLSVTPGQPASISCKSSQSLVHSNGNTYLHWYLQKPGQSPQLL IYKVSNRFSGVPDRFSGSGSGTDFTLKISRVEAEDVGIYYCSQSSIYPWTFGQGTKLEIK | anti-BCMA scFv |
| 810 | QVQLVQSGAEVKKPGASVKVSCKASGYSFPDYYINWVRQAPGQGLEWMGWIYFASGNSEYNQ KFTGRVTMTRDTSINTAYMELSSLTSEDTAVYFCASLYDYDWYFDVWGQGTMVTVSSGGGGS GGGGSGGGGSDIVMTQTPLSLSVTPGQPASISCKSSQSLVHSNGNTYLHWYLQKPGQSPQLL IYKVSNRFSGVPDRFSGSGSGTDFTLKISRVEAEDVGIYYCSQSSIYPWTFGQGTKLEIK | anti-BCMA scFv |
| 811 | QVQLVQSGAEVKKPGASVKVSCKASGYSFPDYYINWVRQAPGQGLEWMGWIYFASGNSEYNQ KFTGRVTMTRDTSSSTAYMELSSLRSEDTAVYFCASLYDYDWYFDVWGQGTMVTVSSGGGGS GGGGSGGGGSDIVMTQTPLSLSVTPGEPASISCKSSQSLVHSNGNTYLHWYLQKPGQSPQLL IYKVSNRFSGVPDRFSGSGSGADFTLKISRVEAEDVGVYYCAETSHVPWTFGQGTKLEIK | anti-BCMA scFv |
| 812 | QVQLVQSGAEVKKPGASVKVSCKASGYSFPDYYINWVRQAPGQGLEWMGWIYFASGNSEYNQ KFTGRVTMTRDTSSSTAYMELSSLRSEDTAVYFCASLYDYDWYFDVWGQGTMVTVSSGGGGS GGGGSGGGGSDIVMTQTPLSLSVTPGEPASISCKSSQSLVHSNGNTYLHWYLQKPGQSPQLL IYKVSNRFSGVPDRFSGSGSGADFTLKISRVEAEDVGVYYCAETSHVPWTFGQGTKLEIK | anti-BCMA scFv |
| 813 | QVQLVQSGAEVKKPGASVKVSCKASGYSFPDYYINWVRQAPGQGLEWMGWIYFASGNSEYNQ KFTGRVTMTRDTSSSTAYMELSSLRSEDTAVYFCASLYDYDWYFDVWGQGTMVTVSSGGGGS GGGGSGGGGSDIVMTQTPLSLSVTPGEPASISCKSSQSLVHSNGNTYLHWYLQKPGQSPQLL IYKVSNRFSGVPDRFSGSGSGADFTLKISRVEAEDVGVYYCAETSHVPWTFGQGTKLEIK | anti-BCMA scFv |
| 814 | QVQLVESGGGLVQPGGSLRLSCEASGFTLDYYAIGWFRQAPGKEREGVICISRSDGSTYYAD SVKGRFTISRDNAKKTVYLQMISLKPEDTAAYYCAAGADCSGYLRDYEFRGQGTQVTVSS | anti-BCMA VH |

-continued

| SEQ ID NO | SEQUENCE | Description |
|---|---|---|
| 815 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSS | anti-BMCA VH |
| 816 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSS | anti-BMCA VH |
| 817 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSS | anti-BMCA VH |
| 818 | QVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSS | anti-BMCA VH |
| 819 | QLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSS | anti-BMCA VH |
| 820 | EVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSS | anti-BMCA VH |
| 821 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARTDFWSGSPPGLDYWGQGTLVTVSS | anti-BMCA VH |
| 822 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSS | anti-BMCA VH |
| 823 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSS | anti-BMCA VH |
| 824 | QVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSS | anti-BMCA VH |
| 825 | EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS | anti-BMCA VH |
| 826 | QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS | anti-BMCA VH |
| 827 | QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS | anti-BMCA VH |
| 828 | EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS | anti-BMCA VH |
| 829 | QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS | anti-BMCA VH |
| 830 | QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS | anti-BMCA VH |
| 831 | QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSS | anti-BMCA VH |
| 832 | QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSS | anti-BMCA VH |
| 833 | LPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLG | anti-BCMA VL |
| 834 | EIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIK | anti-BCMA VL |
| 835 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIK | anti-BCMA VL |
| 836 | EIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIK | anti-BCMA VL |
| 837 | EIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIK | anti-BCMA VL |
| 838 | EIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIK | anti-BCMA VL |

| SEQ ID NO | SEQUENCE | Description |
|---|---|---|
| 839 | DIQLTQSPSSVSASVGDRVTITCRASQGISSWLAWYQQKPGKAPKLLIYGASSLQSGVPSRF SGSGSGTDFTLTISSLQPEDFATYYCQQIYTFPFTFGGGTKVEIK | anti-BCMA VL |
| 840 | DIVMTQSPDSLAVSLGERATINCKSSQSVLYSSNNKNYLAWYQQKPGQPPKLLIYWASTRES GVPDRFSGSGSGTDFTLTISSLQAEDVAVYYCQQFAHTPFTFGGGTKVEIK | anti-BCMA VL |
| 841 | EIVMTQSPATLSVSPGERATLSCRASQSVSSNLAWYQQKPGQAPRLLIYSASTRATGIPARF SGSGSGTEFTLTISSLQSEDFAVYYCQQHHVWPLTFGGGTKVEIK | anti-BCMA VL |
| 842 | DIVLTQSPASLAVSLGERATINCRASESVSVIGAHLIHWYQQKPGQPPKLLIYLASNLETGV PARFSGSGSGTDFTLTISSLQAEDAAIYYCLQSRIFPRTFGQGTKLEIK | anti-BCMA VL |
| 843 | DIQLTQSPSSLSASVGDRVTITCRASQSISSYLNWYQQKPGKAPKLLIYAASSLQSGVPSRF SGSGSGTDFTLTISSLQPEDFATYYCQQSYSTPYTFGQGTKVEIK | anti-BCMA VL |
| 844 | DIVLTQSPGTLSLSPGERATLSCRASQSISSSFLAWYQQKPGQAPRLLIYGASRRATGIPDR FSGSGSGTDFTLTISRLEPEDSAVYYCQQYHSSPSWTFGQGTKLEIK | anti-BCMA VL |
| 845 | DIRLTQSPSPLSASVGDRVTITCQASEDINKFLNWYHQTPGKAPKLLIYDASTLQTGVPSRF SGSGSGTDFTLTINSLQPEDIGTYYCQQYESLPLTFGGGTKVEIK | anti-BCMA VL |
| 846 | EIVLTQSPGTLSLSPGERATLSCRASQSIGSSSLAWYQQKPGQAPRLLMYGASSRASGIPDR FSGSGSGTDFTLTISRLEPEDFAVYYCQQYAGSPPFTFGQGTKVEIK | anti-BCMA VL |
| 847 | DIVLTQSPPSLAMSLGKRATISCRASESVTILGSHLIYWYQQKPGQPPTLLIQLASNVQTGV PARFSGSGSRTDFTLTIDPVEEDDVAVYYCLQSRTIPRTFGGGTKLEIK | anti-BCMA VL |
| 848 | DIVMTQTPLSLSVTPGQPASISCKSSQSLVHSNGNTYLHWYLQKPGQSPQLLIYKVSNRFSG VPDRFSGSGSGTDFTLKISRVEAEDVGIYYCSQSSIYPWTFGQGTKLEIK | anti-BCMA VL |
| 849 | DIVMTQTPLSLSVTPGEPASISCKSSQSLVHSNGNTYLHWYLQKPGQSPQLLIYKVSNRFSG VPDRFSGSGSGADFTLKISRVEAEDVGVYYCAETSHVPWTFGQGTKLEIK | anti-BCMA VL |
| 850 | atgcttctcctggtgacaagccttctgctctgtgagttaccacacccagcattcctcctgat ccca | GMCSFR alpha chain signal sequence |
| 851 | MLLLVTSLLLCELPHPAFLLIP | GMCSFR alpha chain signal peptide |
| 852 | MALPVTALLLPLALLLHA | CD8 alpha signal peptide |
| 853 | MPLLLLLPLLWAGALA | CD33 signal peptide |
| 854 | aagtttctttctgtattccagactgaccgtggataaatctc | Optimized splice acceptor site |
| 855 | GAGTCTAAATACGGACCGCCTTGTCCTCCTTGTCCAGCTCCTCCTGTTGCCGGACCTTCCGT GTTCCTGTTTCCTCCAAAGCCTAAGGACACCCTGATGATCAGCAGGACCCCTGAAGTGACCT GCGTGGTGGTGGATGTGTCCCAAGAGGATCCCGAGGTGCAGTTCAATTGGTACGTGGACGGC GTGGAAGTGCACAACGCCAAGACCAAGCCTAGAGAGGAACAGTTCCAGAGCACCTACAGAGT GGTGTCCGTGCTGACAGTGCTGCACCAGGATTGGCTGAACGGCAAAGAGTACAAGTGCAAGG TGTCCAACAAGGGCCTGCCTAGCAGCATCGAGAAAACCATCTCCAAGGCCAAGGGCCAGCCA AGAGAGCCCCAGGTTTACACACTGCCTCCAAGCCAAGAGGAAATGACCAAGAATCAGGTGTC CCTGACATGCCTGGTCAAGGGCTTCTACCCCTCCGATATCGCCGTGGAATGGGAGAGCAATG GCCAGCCTGAGAACAACTACAAGACCACACCTCCTGTGCTGGACAGCGACGGCAGTTTCTTC CTGTATAGTAGACTCACCGTGGATAAATCAAGATGGCAAGAGGGCAACGTGTTCAGCTGCAG CGTGATGCACGAGGCCCTGCACAACCACTACACCCAGAAAAGCCTGAGCCTGTCTCTGGGCA AA | Spacer - codon optimized (nt) |
| 856 | gaatctaagtacggaccgccttgtcctccttgtcccgctcctcctgttgccggaccttccgt gttcctgtttcctccaaagcctaaggacaccctgatgatcagcaggacccctgaagtgacct gcgtggtggtggatgtgtcccaagaggatcccgaggtgcagttcaactggtatgtggacggc gtggaagtgcacaacgccaagaccaagcctagagaggaacagttccagagcacctacagagt ggtgtccgtgctgacagtgctgcaccaggattggctgaacggcaaagagtacaagtgcaagg tgtccaacaagggcctgcctagcagcatcgagaaaaccatctccaaggccaagggccagcca agagagccccaggtttacacactgcctccaagccaagaggaaatgaccaagaatcaggtgtc cctgacatgcctggtcaagggcttctacccctccgatatcgccgtggaatgggagagcaatg gccagcctgagaacaactacaagaccacacctcctgtgctggacagcgacggcagtttcttc ctgtatagtagactcaccgtggataaatcaagatggcaagagggcaacgtgttcagctgcag cgtgatgcacgaggccctgcacaaccactacacccagaaaagcctgagcctgtctctgggca ag | Alternative CO/SSE spacer (nt) |

SEQUENCE LISTING (856 sequences)

SEQ ID NO: 1 - protein, 5 aa, Artificial Sequence
  Synthetic
  BCMA-1, -3, -4, -5, -6, -7, -8, -25, -31, -42, -44, -45, -46, -51 CDR-H1 (aa) Kabat numbering
DYAMS

SEQ ID NO: 2 - protein, 5 aa, Artificial Sequence
  Synthetic
  BCMA-2, -9, -10, -12, -17, -21, -22, -23, -24, -26, -32, -33, -35, -36, -37, -38, -40, -41, -47, -48, -49 CDR-H1 (aa) Kabat numbering
DYYMS

SEQ ID NO: 3 - protein, 5 aa, Artificial Sequence
  Synthetic
  BCMA-11, -20, -27, -28, -29, -30, -34, -39 CDR-H1 (aa) Kabat numbering
DYAMH

SEQ ID NO: 4 - protein, 19 aa, Artificial Sequence
  Synthetic
  BCMA-1, -3, -4, -5, -6, -7, -8, -25, -31, -42, -44, -45, -46, -51 CDR-H2 (aa) Kabat numbering
FIRSKAYGGTTEYAASVKG

SEQ ID NO: 5 - protein, 17 aa, Artificial Sequence
  Synthetic
  BCMA-2, -9, -10, -12, -17, -21, -22, -23, -26, -32, -35, -36, -37, -38, -40, -47, -48, -49 CDR-H2 (aa) Kabat numbering
YISSSGSTIYYADSVKG

SEQ ID NO: 6 - protein, 17 aa, Artificial Sequence
  Synthetic
  BCMA-11, -20, -24, -27, -29, -30, -34, -39 CDR-H2 (aa) Kabat numbering
GISWNSGSIGYADSVKG

SEQ ID NO: 7 - protein, 7 aa, Artificial Sequence
  Synthetic
  BCMA-1, -3, -4, -5, -6, -7, -8, -25, -31, -42, -44, -45, -46, -51 and VH-2 CDR-H3 (aa)
WSAPTDY

SEQ ID NO: 8 - protein, 9 aa, Artificial Sequence
  Synthetic
  BCMA-2 CDR-H3 (aa)
VDGPPSSDI

SEQ ID NO: 9 - protein, 9 aa, Artificial Sequence
  Synthetic
  BCMA-9, -36, -37, -38, -41 and VH-8 CDR-H3 (aa)
VDGDYVDDY

SEQ ID NO: 10 - protein, 9 aa, Artificial Sequence
  Synthetic
  BCMA-10, -12, -26, -32, -47, -48, -49 and VH-1 CDR-H3 (aa)
VDGPPSFDI

SEQ ID NO: 11 - protein, 13 aa, Artificial Sequence
  Synthetic
  BCMA-11, -34 CDR-H3 (aa)
DLGPDYDPDAFDI

SEQ ID NO: 12 - protein, 7 aa, Artificial Sequence
  Synthetic
  BCMA-1, -3, -4, -5, -6, -7, -8, -25, -30, -31, -42, -44, -45, -46, -51 CDR-H1 (aa) Chothia numbering
GFTFGDY

SEQ ID NO: 13 - protein, 7 aa, Artificial Sequence
  Synthetic
  BCMA-2, -9, -12, -17, -21, -22, -23, -24, -26, -32, -33, -35, -36, -37, -38, -40, -41, -47, -48, -49 CDR-H1 (aa) Chothia numbering
GFTFSDY

SEQ ID NO: 14 - protein, 7 aa, Artificial Sequence
  Synthetic
  BCMA-10 CDR-H1 (aa) Chothia numbering
GFPFSDY

SEQ ID NO: 15 - protein, 7 aa, Artificial Sequence
  Synthetic
  BCMA-11, -20, -27, -28, -29, -34, -39 CDR-H1 (aa) Chothia numbering
GFTFDDY

SEQ ID NO: 16 - protein, 8 aa, Artificial Sequence
  Synthetic
  BCMA-1, -3, -4, -5, -6, -7, -8, -25, -31, -42, -44, -45, -46, -51 CDR-H2 (aa) Chothia numbering
RSKAYGGT

SEQ ID NO: 17 - protein, 6 aa, Artificial Sequence
  Synthetic
  BCMA-2, -9, -10, -12, -17, -21, -22, -23, -26, -32, -35, -36, -37, -38, -40, -47, -48 CDR-H2 (aa) Chothia numbering
SSSGST

SEQ ID NO: 18 - protein, 6 aa, Artificial Sequence
  Synthetic
  BCMA-11, -20, -24, -27, -29, -30, -34, -39 CDR-H2 (aa) Chothia numbering
SWNSGS

SEQ ID NO: 19 - protein, 10 aa, Artificial Sequence
  Synthetic
  BCMA-1, -3, -4, -5, -6, -7, -8, -25, -31, -42, -44, -45, -46, -51 CDR-H1 (aa) AbM numbering
GFTFGDYAMS

SEQ ID NO: 20 - protein, 10 aa, Artificial Sequence
  Synthetic
  BCMA-2, -9, -12, -17, -21, -22, -23, -24, -26, -32, -33, -35, -36, -37, -38, -40, -41, -47, -48, -49 CDR-H1 (aa) AbM numbering
GFTFSDYYMS

SEQ ID NO: 21 - protein, 10 aa, Artificial Sequence
  Synthetic
  BCMA-10 CDR-H1 (aa) AbM numbering
GFPFSDYYMS

SEQ ID NO: 22 - protein, 10 aa, Artificial Sequence
  Synthetic
  BCMA-11, -20, -27, -28, -29, -34, -39 CDR-H1 (aa) AbM numbering
GFTFDDYAMH

SEQ ID NO: 23 - protein, 12 aa, Artificial Sequence
  Synthetic
  BCMA-1, -3, -4, -5, -6, -7, -8, -25, -31, -42, -44, -45, -46, -51 CDR-H2 (aa) AbM numbering
FIRSKAYGGTTE

SEQ ID NO: 24 - protein, 10 aa, Artificial Sequence
  Synthetic
  BCMA-2, -9, -10, -12, -17, -21, -22, -23, -26, -32, -35, -36, -37, -38, -40, -47, -48, -49 CDR-H2 (aa) AbM numbering
YISSSGSTIY

SEQ ID NO: 25 - protein, 10 aa, Artificial Sequence
  Synthetic
  BCMA-11, -20, -24, -27, -29, -30, -34, -39 CDR-H2 (aa) AbM numbering
GISWNSGSIG

SEQ ID NO: 26 - protein, 17 aa, Artificial Sequence
  Synthetic
  BCMA-1 CDR-L1 (aa)
KSSQSVLSTSNNKNYLA

SEQ ID NO: 27 - protein, 11 aa, Artificial Sequence
  Synthetic
  BCMA-2 CDR-L1 (aa)
RASQSIKTNLA

SEQ ID NO: 28 - protein, 17 aa, Artificial Sequence
  Synthetic
  BCMA-3, -46 CDR-L1 (aa)
KSSQSVLHSSNNKNYLA

SEQ ID NO: 29 - protein, 11 aa, Artificial Sequence
  Synthetic
  BCMA-4 CDR-L1 (aa)
RASQDIRNSLA

SEQ ID NO: 30 - protein, 17 aa, Artificial Sequence
  Synthetic
  BCMA-5, -8, -24 CDR-L1 (aa)
KSSQSVLYSSNNKNYLA

SEQ ID NO: 31 - protein, 11 aa, Artificial Sequence
  Synthetic
  BCMA-6 CDR-L1 (aa)
RASQSISNSLA

SEQ ID NO: 32 - protein, 11 aa, Artificial Sequence
  Synthetic
  BCMA-7 CDR-L1 (aa)
RASQDIGDYLA

SEQ ID NO: 33 - protein, 11 aa, Artificial Sequence
  Synthetic
  BCMA-9, -26, -35 CDR-L1 (aa)
GANNIGSKSVH

SEQ ID NO: 34 - protein, 11 aa, Artificial Sequence
  Synthetic
  BCMA-10 CDR-L1 (aa)
GGNNIERKNVH

SEQ ID NO: 35 - protein, 13 aa, Artificial Sequence
  Synthetic
  BCMA-11 CDR-L1 (aa)
SGSSSNIGSNAVN

SEQ ID NO: 36 - protein, 13 aa, Artificial Sequence
  Synthetic
  BCMA-12 CDR-L1 (aa)
SGSRSNIGNNYVS

SEQ ID NO: 37 - protein, 7 aa, Artificial Sequence
  Synthetic
  BCMA-1 CDR-L2 (aa)
WASTREA

SEQ ID NO: 38 - protein, 7 aa, Artificial Sequence
  Synthetic
  BCMA-2 CDR-L2 (aa)
AASTRAT

SEQ ID NO: 39 - protein, 7 aa, Artificial Sequence
  Synthetic
  BCMA-3, -5, -8, -31, -44, -46 CDR-L2 (aa)
WASTRES

SEQ ID NO: 40 - protein, 7 aa, Artificial Sequence
  Synthetic
  BCMA-4, -42 CDR-L2 (aa)
AASRLES

SEQ ID NO: 41 - protein, 7 aa, Artificial Sequence
  Synthetic
  BCMA-6 CDR-L2 (aa)
AASNVED

SEQ ID NO: 42 - protein, 7 aa, Artificial Sequence
  Synthetic
  BCMA-7 CDR-L2 (aa)
VASTLQS

SEQ ID NO: 43 - protein, 7 aa, Artificial Sequence
  Synthetic
  BCMA-9, -26, -35 CDR-L2 (aa)
DDDDRPS

SEQ ID NO: 44 - protein, 7 aa, Artificial Sequence
  Synthetic
  BCMA-10 CDR-L2 (aa)
DDSDRAS

SEQ ID NO: 45 - protein, 7 aa, Artificial Sequence
  Synthetic
  BCMA-11 CDR-L2 (aa)
NSHQRPS

SEQ ID NO: 46 - protein, 7 aa, Artificial Sequence
  Synthetic
  BCMA-12 CDR-L2 (aa)
DNAKRPS

SEQ ID NO: 47 - protein, 9 aa, Artificial Sequence
  Synthetic
  BCMA-1 CDR-L3 (aa)
QQYFSSPYT

SEQ ID NO: 48 - protein, 8 aa, Artificial Sequence
  Synthetic
  BCMA-2 CDR-L3 (aa)
QQYGSSPT

SEQ ID NO: 49 - protein, 9 aa, Artificial Sequence
  Synthetic
  BCMA-3, -46 CDR-L3 (aa)
QQYYTTPLT

SEQ ID NO: 50 - protein, 9 aa, Artificial Sequence
  Synthetic
  BCMA-4 CDR-L3 (aa)
QQYYSLPLS

SEQ ID NO: 51 - protein, 9 aa, Artificial Sequence
  Synthetic
  BCMA-5 CDR-L3 (aa)
QQYYSTPWT

SEQ ID NO: 52 - protein, 9 aa, Artificial Sequence
  Synthetic
  BCMA-6 CDR-L3 (aa)
QQSHMYPPT

SEQ ID NO: 53 - protein, 9 aa, Artificial Sequence
  Synthetic
  BCMA-7 CDR-L3 (aa)
QQYHSHPWT

SEQ ID NO: 54 - protein, 9 aa, Artificial Sequence
  Synthetic
  BCMA-8, -31 CDR-L3 (aa)
QQYYSTPYT

SEQ ID NO: 55 - protein, 11 aa, Artificial Sequence
  Synthetic
  BCMA-9 CDR-L3 (aa)
HVWDRSRDHYV

SEQ ID NO: 56 - protein, 11 aa, Artificial Sequence
  Synthetic
  BCMA-10 CDR-L3 (aa)
QAWDSSSTLYV

SEQ ID NO: 57 - protein, 11 aa, Artificial Sequence
  Synthetic
  BCMA-11 CDR-L3 (aa)
AAWDDSLRGYV

SEQ ID NO: 58 - protein, 11 aa, Artificial Sequence
  Synthetic
  BCMA-12, -32, -48 CDR-L3 (aa)
QVWDSSSDHWV

SEQ ID NO: 59 - protein, 30 aa, Artificial Sequence
  Synthetic
  BCMA-1, -3, -4, -5, -6, -7, -8, -45, -46 VH FR1 (aa)
QVQLVQSGGGLVQPGRSLRLSCTASGFTFG

SEQ ID NO: 60 - protein, 30 aa, Artificial Sequence
  Synthetic
  BCMA-2, -12, -22, -23, -26, -40, -48 VH FR1 (aa)
EVQLVESGGGLVKPGGSLRLSCAASGFTFS

SEQ ID NO: 61 - protein, 30 aa, Artificial Sequence
  Synthetic
  BCMA-9, -24, -35, -37 VH FR1 (aa)
EVQLVQSGGGLVKPGGSLRLSCAASGFTFS

SEQ ID NO: 62 - protein, 30 aa, Artificial Sequence
  Synthetic
  BCMA-10 VH FR1 (aa)
EVQLVESGGGLVKPGGSLRLSCAASGFPFS

SEQ ID NO: 63 - protein, 30 aa, Artificial Sequence
  Synthetic
  BCMA-11, -28, -29, -39 VH FR1 (aa)
QVQLVQSGGGLVQPGRSLRLSCAASGFTFD

SEQ ID NO: 64 - protein, 14 aa, Artificial Sequence
  Synthetic
  BCMA-1, -3, -4, -5, -6, -7, -8, -25, -31, -42, -44, -45, -46, -51 VH FR2 (aa)
WFRQAPGKGLEWVG

SEQ ID NO: 65 - protein, 14 aa, Artificial Sequence
  Synthetic
  BCMA-2, -9, -10, -12, -21, -22, -23, -24, -26, -32, -33, -35, -36, -37, -38, -40, -41, -47, -48, -49 VH FR2 (aa)
WIRQAPGKGLEWVS

SEQ ID NO: 66 - protein, 14 aa, Artificial Sequence
  Synthetic
  BCMA-11 VH FR2 (aa)
WVRRAPGKGLEWVS

SEQ ID NO: 67 - protein, 32 aa, Artificial Sequence
  Synthetic
  BCMA-1, -3, -4, -5, -6, -7, -8, -25, -31, -42, -44, -45, -46, -51 VH FR3 (aa)
RFTISRDDSKSIAYLQMNSLKTEDTAVYYCAA

SEQ ID NO: 68 - protein, 32 aa, Artificial Sequence
  Synthetic
  BCMA-2, -10, -12, -21, -22, -23, -26, -32, -40, -41, -48, -49 VH FR3 (aa)
RFTISRDNAKNSLYLQMNSLRAEDTAVYYCAK

SEQ ID NO: 69 - protein, 32 aa, Artificial Sequence
  Synthetic
  BCMA-9, -11, -17, -24, -28, -29, -30, -33, -34, -35, -36, -38, -39 VH FR3 (aa)
RFTISRDNAKNSLYLQMNSLRAEDTAVYYCAR

SEQ ID NO: 70 - protein, 11 aa, Artificial Sequence
  Synthetic
  BCMA-1, -3, -4, -5, -6, -7, -8, -9, -15, -16, -18, -20, -21, -22, -23, -25, -27, -31, -35, -36, -37, -38, -40, -41, -42, -44, -45, -46, -51 VH FR4 (aa)
WGQGTLVTVSS

SEQ ID NO: 71 - protein, 11 aa, Artificial Sequence
  Synthetic
  BCMA-2, -10, -11, -12, -24, -26, -29, -30, -32, -34, -39, -48, -49, -50 VH FR4 (aa)
WGQGTMVTVSS

SEQ ID NO: 72 - protein, 23 aa, Artificial Sequence
  Synthetic
  BCMA-1 VL FR1 (aa)
DIVMTQSPDSLSVSPGERATISC

SEQ ID NO: 73 - protein, 23 aa, Artificial Sequence
  Synthetic
  BCMA-2 VL FR1 (aa)
EIVMTQSPATLSVSPGETATLSC

SEQ ID NO: 74 - protein, 23 aa, Artificial Sequence
  Synthetic
  BCMA-3, -46 VL FR1 (aa)
DIVMTQSPDSLVVSLGERATINC

SEQ ID NO: 75 - protein, 23 aa, Artificial Sequence
  Synthetic
  BCMA-4 VL FR1 (aa)
AIRMTQSPSSLSASLGDRVTITC

SEQ ID NO: 76 - protein, 23 aa, Artificial Sequence
  Synthetic
  BCMA-5, -8, -24 VL FR1 (aa)
DIVMTQSPDSLAVSLGERATINC

SEQ ID NO: 77 - protein, 23 aa, Artificial Sequence
  Synthetic
  BCMA-6 VL FR1 (aa)
DIVMTQSPSSLSVSVGERVTITC

SEQ ID NO: 78 - protein, 23 aa, Artificial Sequence
  Synthetic
  BCMA-7 VL FR1 (aa)
VIQLTQSPSSLSASVGDRVTITC

SEQ ID NO: 79 - protein, 22 aa, Artificial Sequence
  Synthetic
  BCMA-9 VL FR1 (aa)
SYELTQPPSVSVAPGQTARVTC

SEQ ID NO: 80 - protein, 22 aa, Artificial Sequence
  Synthetic
  BCMA-10, -26 VL FR1 (aa)
SYVLTQPPSVSVAPGQTARITC

SEQ ID NO: 81 - protein, 22 aa, Artificial Sequence
  Synthetic
  BCMA-11 VL FR1 (aa)
QLVLTQPPSASGTPGQRVTISC

SEQ ID NO: 82 - protein, 22 aa, Artificial Sequence
  Synthetic
  BCMA-12 VL FR1 (aa)
QSALTQPPSVSAAPGQKVTISC

SEQ ID NO: 83 - protein, 15 aa, Artificial Sequence
  Synthetic
  BCMA-1 VL FR2 (aa)
WYQQKPGQPPRLLLY

SEQ ID NO: 84 - protein, 15 aa, Artificial Sequence
  Synthetic
  BCMA-2, -34 VL FR2 (aa)
WYQQKPGQAPRLLIY

SEQ ID NO: 85 - protein, 15 aa, Artificial Sequence
  Synthetic
  BCMA-3, -5, -8, -24, -44, -46 VL FR2 (aa)
WYQQKPGQPPKLLIY

SEQ ID NO: 86 - protein, 15 aa, Artificial Sequence
  Synthetic
  BCMA-4 VL FR2 (aa)
WYQQRPGKAPKLLLS

SEQ ID NO: 87 - protein, 15 aa, Artificial Sequence
  Synthetic
  BCMA-6 VL FR2 (aa)
WYKQRPGEAPKLLIH

SEQ ID NO: 88 - protein, 15 aa, Artificial Sequence
  Synthetic
  BCMA-7 VL FR2 (aa)
WFQQRPGKAPKSLIY

SEQ ID NO: 89 - protein, 15 aa, Artificial Sequence
  Synthetic
  BCMA-9, -26, -35 VL FR2 (aa)
WYQQKPGQAPMLVVY

SEQ ID NO: 90 - protein, 15 aa, Artificial Sequence
  Synthetic
  BCMA-10 VL FR2 (aa)
WYQQKPGQAPVPVVY

SEQ ID NO: 91 - protein, 15 aa, Artificial Sequence
  Synthetic
  BCMA-11 VL FR2 (aa)
WYQQLPGTAPEVLIY

SEQ ID NO: 92 - protein, 15 aa, Artificial Sequence
  Synthetic
  BCMA-12 VL FR2 (aa)
WYQQLPGTAPKLLIY

SEQ ID NO: 93 - protein, 32 aa, Artificial Sequence
  Synthetic
  BCMA-1, -3, -5, -8, -31, -44, -46 VL FR3 (aa)
GVPDRFSGSGSGTDFTLTISSLQAEDVAVYYC

SEQ ID NO: 94 - protein, 32 aa, Artificial Sequence
  Synthetic
  BCMA-2 VL FR3 (aa)
GIPDRFSGSGSGTDFTLTITRLEPEDFAVYYC

SEQ ID NO: 95 - protein, 32 aa, Artificial Sequence
  Synthetic
  BCMA-4 VL FR3 (aa)
GVPSRFSGTTSGAEYALSISSLQPEDVASYFC

SEQ ID NO: 96 - protein, 32 aa, Artificial Sequence
  Synthetic
  BCMA-6 VL FR3 (aa)
GVPSRFSGRGSGTVFTLAISNVQPEDFATYYC

SEQ ID NO: 97 - protein, 32 aa, Artificial Sequence
  Synthetic
  BCMA-7 VL FR3 (aa)
GVPSRFSGSGSGTHFTLTINSLQPEDFATYYC

SEQ ID NO: 98 - protein, 32 aa, Artificial Sequence
  Synthetic
  BCMA-9, -26, -35 VL FR3 (aa)
GIPERFSGSNSGNTATLTISGVEAGDEADYFC

SEQ ID NO: 99 - protein, 32 aa, Artificial Sequence
  Synthetic
  BCMA-10 VL FR3 (aa)
GIPERFSASNSGNTATLTISGAQATDEAEYYC

SEQ ID NO: 100 - protein, 32 aa, Artificial Sequence
  Synthetic
  BCMA-11 VL FR3 (aa)
GVPDRFSGSKSGTSASLAINGLQSEDEADYYC

SEQ ID NO: 101 - protein, 32 aa, Artificial Sequence
  Synthetic
  BCMA-12 VL FR3 (aa)
GIPDRFSGSKSGTSATLDIAGLQTGDEADYYC

SEQ ID NO: 102 - protein, 10 aa, Artificial Sequence
  Synthetic
  BCMA-1 VL FR4 (aa)
FGHGTKLEIK

SEQ ID NO: 103 - protein, 10 aa, Artificial Sequence
  Synthetic
  BCMA-2, -39 VL FR4 (aa)
FGRGTKLEIK

SEQ ID NO: 104 - protein, 10 aa, Artificial Sequence
  Synthetic
  BCMA-3, -4, -6, -30, -46 VL FR4 (aa)
FGGGTKVEIK

SEQ ID NO: 105 - protein, 10 aa, Artificial Sequence
  Synthetic
  BCMA-5, -45 VL FR4 (aa)
FGQGTKVDIK

SEQ ID NO: 106 - protein, 10 aa, Artificial Sequence
  Synthetic
  BCMA-7 VL FR4 (aa)
FGPGTKVDIK

SEQ ID NO: 107 - protein, 10 aa, Artificial Sequence
  Synthetic
  BCMA-8, -44 VL FR4 (aa)
FGQGTKLEIK

SEQ ID NO: 108 - protein, 10 aa, Artificial Sequence
  Synthetic
  BCMA-9, -10, -11, -26, -40, -47 VL FR4 (aa)
FGTGTKLTVL

SEQ ID NO: 109 - protein, 10 aa, Artificial Sequence
  Synthetic
  BCMA-12, -14, -15, -16, -17, -18, -32, -33, -36, -37, -38, -41, -48, -49, -50 VL FR4 (aa)
FGGGTKLTVL

SEQ ID NO: 110 - protein, 118 aa, Artificial Sequence
  Synthetic
  BCMA-1, -3, -4, -5, -6, -7, -8, -45, -46 VH Chain (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSS

SEQ ID NO: 111 - protein, 118 aa, Artificial Sequence
  Synthetic
  BCMA-2 VH Chain (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSSDIWGQGTMVTVSS

SEQ ID NO: 112 - protein, 118 aa, Artificial Sequence
  Synthetic
  BCMA-9 VH Chain (aa)
EVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYVDDYWGQGTLVTVSS

SEQ ID NO: 113 - protein, 118 aa, Artificial Sequence
  Synthetic
  BCMA-10 VH Chain (aa)
EVQLVESGGGLVKPGGSLRLSCAASGFPFSDYYMSWIRQAPGKGLEWVSYISSSGSTIYYADSVKGRFTISRDNAKNSLYLQMNSLRAEDTAVYYCAKVDGPPSFDIWGQGTMVTVSS

SEQ ID NO: 114 - protein, 122 aa, Artificial Sequence
  Synthetic
  BCMA-11 VH Chain (aa)
QVQLVQSGGGLVQPGRSLRLSCAASGFTFDDYAMHWVRRAPGKGLEWVSGISWNSGSIGYADSVKGRFTISRDNAKNSLYLQMNSLRAEDTAVYYCARDLGPDYDPDAFDIWGQGTMVTVSS

SEQ ID NO: 115 - protein, 118 aa, Artificial Sequence
  Synthetic
  BCMA-12, -26, -48 VH Chain (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSS

SEQ ID NO: 116 - protein, 113 aa, Artificial Sequence
  Synthetic
  BCMA-1 VL Chain (aa)
DIVMTQSPDSLSVSPGERATISCKSSQSVLSTSNNKNYLAWYQQKPGQPPRLLLYWASTREAGVPDRFSGSGSGTDFTLTISSLQAEDVAVYYCQQYFSSPYTFGHGTKLEIK

SEQ ID NO: 117 - protein, 106 aa, Artificial Sequence
  Synthetic
  BCMA-2 VL Chain (aa)
EIVMTQSPATLSVSPGETATLSCRASQSIKTNLAWYQQKPGQAPRLLIYAASTRATGIPDRFSGSGSGTDFTLTITRLEPEDFAVYYCQQYGSSPTFGRGTKLEIK

SEQ ID NO: 118 - protein, 113 aa, Artificial Sequence
  Synthetic
  BCMA-3, -46 VL Chain (aa)
DIVMTQSPDSLVVSLGERATINCKSSQSVLHSSNNKNYLAWYQQKPGQPPKLLIYWASTRESGVPDRFSGSGSGTDFTLTISSLQAEDVAVYYCQQYYTTPLTFGGGTKVEIK

SEQ ID NO: 119 - protein, 107 aa, Artificial Sequence
  Synthetic
  BCMA-4 VL Chain (aa)
AIRMTQSPSSLSASLGDRVTITCRASQDIRNSLAWYQQRPGKAPKLLLSAASRLESGVPSRFSGTTSGAEYALSISSLQPEDVASYFCQQYYSLPLSFGGGTKVEIK

SEQ ID NO: 120 - protein, 113 aa, Artificial Sequence
  Synthetic
  BCMA-5 VL Chain (aa)
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVDIK

SEQ ID NO: 121 - protein, 107 aa, Artificial Sequence
  Synthetic
  BCMA-6 VL Chain (aa)
DIVMTQSPSSLSVSVGERVTITCRASQSISNSLAWYKQRPGEAPKLLIHAASNVEDGVPSRFSGRGSGTVFTLAISNVQPEDFATYYCQQSHMYPPTFGGGTKVEIK

SEQ ID NO: 122 - protein, 107 aa, Artificial Sequence
  Synthetic
  BCMA-7 VL Chain (aa)
VIQLTQSPSSLSASVGDRVTITCRASQDIGDYLAWFQQRPGKAPKSLIYVASTLQSGVPSRFSGSGSGTHFTLTINSLQPEDFATYYCQQYHSHPWTFGPGTKVDIK

SEQ ID NO: 123 - protein, 113 aa, Artificial Sequence
  Synthetic
  BCMA-8 VL Chain (aa)
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 124 - protein, 108 aa, Artificial Sequence
  Synthetic
  BCMA-9 VL Chain (aa)
SYELTQPPSVSVAPGQTARVTCGANNIGSKSVHWYQQKPGQAPMLVVYDDDDRPSGIPERFSGSNSGNTATLTISGVEAGDEADYFCHVWDRSRDHYVFGTGTKLTVL

SEQ ID NO: 125 - protein, 108 aa, Artificial Sequence
  Synthetic
  BCMA-10 VL Chain (aa)
SYVLTQPPSVSVAPGQTARITCGGNNIERKNVHWYQQKPGQAPVPVVYDDSDRASGIPERFSASNSGNTATLTISGAQATDEAEYYCQAWDSSSTLYVFGTGTKLTVL

SEQ ID NO: 126 - protein, 110 aa, Artificial Sequence
  Synthetic
  BCMA-11 VL Chain (aa)
QLVLTQPPSASGTPGQRVTISCSGSSSNIGSNAVNWYQQLPGTAPEVLIYNSHQRPSGVPDRFSGSKSGTSASLAINGLQSEDEADYYCAAWDDSLRGYVFGTGTKLTVL

SEQ ID NO: 127 - protein, 110 aa, Artificial Sequence
  Synthetic
  BCMA-12 VL Chain (aa)
QSALTQPPSVSAAPGQKVTISCSGSRSNIGNNYVSWYQQLPGTAPKLLIYDNAKRPSGIPDRFSGSKSGTSATLDIAGLQTGDEADYYCQVWDSSSDHWVFGGGTKLTVL

SEQ ID NO: 128 - protein, 246 aa, Artificial Sequence
  Synthetic
  BCMA-1 scFv (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIVMTQSPDSLSVSPGERATISCKSSQSVLSTSNNKNYLAWYQQKPGQPPRLLLYWASTREAGVPDRFSGSGSGTDFTLTISSLQAEDVAVYYCQQYFSSPYTFGHGTKLEIK

SEQ ID NO: 129 - protein, 239 aa, Artificial Sequence
  Synthetic
  BCMA-2 scFv (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSSDIWGQGTMVTVSSGGGGSGGGGSGGGGSEIVMTQSPATLSVSPGETATLSCRASQSIKTNLAWYQQKPGQAPRLLIYAASTRATGIPDRFSGSGSGTDFTLTITRLEPEDFAVYYCQQYGSSPTFGRGTKLEIK

SEQ ID NO: 130 - protein, 246 aa, Artificial Sequence
  Synthetic
  BCMA-3, 46 scFv (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIVMTQSPDSLVVSLGERATINCKSSQSVLHSSNNKNYLAWYQQKPGQPPKLLIYWASTRESGVPDRFSGSGSGTDFTLTISSLQAEDVAVYYCQQYYTTPLTFGGGTKVEIK

SEQ ID NO: 131 - protein, 240 aa, Artificial Sequence
  Synthetic
  BCMA-4 scFv (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSAIRMTQSPSSLSASLGDRVTITCRASQDIRNSLAWYQQRPGKAPKLLLSAASRLESGVPSRFSGTTSGAEYALSISSLQPEDVASYFCQQYYSLPLSFGGGTKVEIK

SEQ ID NO: 132 - protein, 246 aa, Artificial Sequence
  Synthetic
  BCMA-5 scFv (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVDIK

SEQ ID NO: 133 - protein, 240 aa, Artificial Sequence
  Synthetic
  BCMA-6 scFv (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIVMTQSPSSLSVSVGERVTITCRASQSISNSLAWYKQRPGEAPKLLIHAASNVEDGVPSRFSGRGSGTVFTLAISNVQPEDFATYYCQQSHMYPPTFGGGTKVEIK

SEQ ID NO: 134 - protein, 240 aa, Artificial Sequence
  Synthetic
  BCMA-7 scFv (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSVIQLTQSPSSLSASVGDRVTITCRASQDIGDYLAWFQQRPGKAPKSLIYVASTLQSGVPSRFSGSGSGTHFTLTINSLQPEDFATYYCQQYHSHPWTFGPGTKVDIK

SEQ ID NO: 135 - protein, 246 aa, Artificial Sequence
  Synthetic
  BCMA-8 scFv (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 136 - protein, 241 aa, Artificial Sequence
  Synthetic
  BCMA-9 scFv (aa)
EVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYVDDYWGQGTLVTVSSGGGGSGGGGSGGGGSSYELTQPPSVSVAPGQTARVTCGANNIGSKSVHWYQQKPGQAPMLVVYDDDDRPSGIPERFSGSNSGNTATLTISGVEAGDEADYFCHVWDRSRDHYVFGTGTKLTVL

SEQ ID NO: 137 - protein, 241 aa, Artificial Sequence
  Synthetic
  BCMA-10 scFv (aa)
EVQLVESGGGLVKPGGSLRLSCAASGFPFSDYYMSWIRQAPGKGLEWVSYISSSGSTIYYADSVKGRFTISRDNAKNSLYLQMNSLRAEDTAVYYCAKVDGPPSFDIWGQGTMVTVSSGGGGSGGGGSGGGGSSYVLTQPPSVSVAPGQTARITCGGNNIERKNVHWYQQKPGQAPVPVVYDDSDRASGIPERFSASNSGNTATLTISGAQATDEAEYYCQAWDSSSTLYVFGTGTKLTVL

SEQ ID NO: 138 - protein, 247 aa, Artificial Sequence
  Synthetic
  BCMA-11 scFv (aa)
QVQLVQSGGGLVQPGRSLRLSCAASGFTFDDYAMHWVRRAPGKGLEWVSGISWNSGSIGYADSVKGRFTISRDNAKNSLYLQMNSLRAEDTAVYYCARDLGPDYDPDAFDIWGQGTMVTVSSGGGGSGGGGSGGGGSQLVLTQPPSASGTPGQRVTISCSGSSSNIGSNAVNWYQQLPGTAPEVLIYNSHQRPSGVPDRFSGSKSGTSASLAINGLQSEDEADYYCAAWDDSLRGYVFGTGTKLTVL

SEQ ID NO: 139 - protein, 243 aa, Artificial Sequence
  Synthetic
  BCMA-12 scFv (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSSGGGGSGGGGSGGGGSQSALTQPPSVSAAPGQKVTISCSGSRSNIGNNYVSWYQQLPGTAPKLLIYDNAKRPSGIPDRFSGSKSGTSATLDIAGLQTGDEADYYCQVWDSSSDHWVFGGGTKLTVL

SEQ ID NO: 140 - protein, 5 aa, Artificial Sequence
  Synthetic
  BCMA-13 CDR-H1 (aa) Kabat numbering
SYAMH

SEQ ID NO: 141 - protein, 5 aa, Artificial Sequence
  Synthetic
  BCMA-14, -15 CDR-H1 (aa) Kabat numbering
SYGMH

SEQ ID NO: 142 - protein, 5 aa, Artificial Sequence
  Synthetic
  BCMA-16 CDR-H1 (aa) Kabat numbering
SSAMQ

SEQ ID NO: 143 - protein, 5 aa, Artificial Sequence
  Synthetic
  BCMA-18 CDR-H1 (aa) Kabat numbering
SYWMS

SEQ ID NO: 144 - protein, 5 aa, Artificial Sequence
  Synthetic
  BCMA-19 CDR-H1 (aa) Kabat numbering
SYYMH

SEQ ID NO: 145 - protein, 17 aa, Artificial Sequence
  Synthetic
  BCMA-13, -14, -15 CDR-H2 (aa) Kabat numbering
VISYDGSNKYYADSVKG

SEQ ID NO: 146 - protein, 17 aa, Artificial Sequence
  Synthetic
  BCMA-16 CDR-H2 (aa) Kabat numbering
WIVVGSGNTNYAQKFQE

SEQ ID NO: 147 - protein, 17 aa, Artificial Sequence
  Synthetic
  BCMA-18 CDR-H2 (aa) Kabat numbering
HINQDGSEKYYVDSVKG

SEQ ID NO: 148 - protein, 17 aa, Artificial Sequence
  Synthetic
  BCMA-19 CDR-H2 (aa) Kabat numbering
WINPNSGGTNYAQKFQG

SEQ ID NO: 149 - protein, 13 aa, Artificial Sequence
  Synthetic
  BCMA-13, -14 CDR-H3 (aa)
LPGRDGYPGAFDY

SEQ ID NO: 150 - protein, 14 aa, Artificial Sequence
  Synthetic
  BCMA-15 CDR-H3 (aa)
DQYSSSAQRADFDY

SEQ ID NO: 151 - protein, 12 aa, Artificial Sequence
  Synthetic
  BCMA-16 CDR-H3 (aa)
APYYDILTGYYL

SEQ ID NO: 152 - protein, 8 aa, Artificial Sequence
  Synthetic
  BCMA-17, -33 CDR-H3 (aa)
EADSSADY

SEQ ID NO: 153 - protein, 6 aa, Artificial Sequence
  Synthetic
  BCMA-18 CDR-H3 (aa)
WLAVTN

SEQ ID NO: 154 - protein, 5 aa, Artificial Sequence
  Synthetic
  BCMA-19 CDR-H3 (aa)
DGGDV

SEQ ID NO: 155 - protein, 12 aa, Artificial Sequence
  Synthetic
  BCMA-20, -27 CDR-H3 (aa)
GGLGITPYYFDY

SEQ ID NO: 156 - protein, 9 aa, Artificial Sequence
  Synthetic
  BCMA-21 CDR-H3 (aa)
VDGGYTEDY

SEQ ID NO: 157 - protein, 9 aa, Artificial Sequence
  Synthetic
  BCMA-22, -23, -40 CDR-H3 (aa)
VDGDYTEDY

SEQ ID NO: 158 - protein, 7 aa, Artificial Sequence
  Synthetic
  BCMA-13, -14, -15, -18 CDR-H1 (aa) Chothia numbering
GFTFSSY

SEQ ID NO: 159 - protein, 7 aa, Artificial Sequence
  Synthetic
  BCMA-16 CDR-H1 (aa) Chothia numbering
GFTFTSS

SEQ ID NO: 160 - protein, 7 aa, Artificial Sequence
  Synthetic
  BCMA-19 CDR-H1 (aa) Chothia numbering
GYTFTSY

SEQ ID NO: 161 - protein, 6 aa, Artificial Sequence
  Synthetic
  BCMA-13, -14, -15 CDR-H2 (aa) Chothia numbering
SYDGSN

SEQ ID NO: 162 - protein, 6 aa, Artificial Sequence
  Synthetic
  BCMA-16 CDR-H2 (aa) Chothia numbering
VVGSGN

SEQ ID NO: 163 - protein, 6 aa, Artificial Sequence
  Synthetic
  BCMA-18 CDR-H2 (aa) Chothia numbering
NQDGSE

SEQ ID NO: 164 - protein, 6 aa, Artificial Sequence
  Synthetic
  BCMA-19 CDR-H2 (aa) Chothia numbering
NPNSGG

SEQ ID NO: 165 - protein, 10 aa, Artificial Sequence
  Synthetic
  BCMA-13 CDR-H1 (aa) AbM numbering
GFTFSSYAMH

SEQ ID NO: 166 - protein, 10 aa, Artificial Sequence
  Synthetic
  BCMA-14, -15 CDR-H1 (aa) AbM numbering
GFTFSSYGMH

SEQ ID NO: 167 - protein, 10 aa, Artificial Sequence
  Synthetic
  BCMA-16 CDR-H1 (aa) AbM numbering
GFTFTSSAMQ

SEQ ID NO: 168 - protein, 10 aa, Artificial Sequence
  Synthetic
  BCMA-18 CDR-H1 (aa) AbM numbering
GFTFSSYWMS

SEQ ID NO: 169 - protein, 10 aa, Artificial Sequence
  Synthetic
  BCMA-19 CDR-H1 (aa) AbM numbering
GYTFTSYYMH

SEQ ID NO: 170 - protein, 10 aa, Artificial Sequence
  Synthetic
  BCMA-13, -14, -15 CDR-H2 (aa) AbM numbering
VISYDGSNKY

SEQ ID NO: 171 - protein, 10 aa, Artificial Sequence
  Synthetic
  BCMA-16 CDR-H2 (aa) AbM numbering
WIVVGSGNTN

SEQ ID NO: 172 - protein, 10 aa, Artificial Sequence
  Synthetic
  BCMA-18 CDR-H2 (aa) AbM numbering
HINQDGSEKY

SEQ ID NO: 173 - protein, 10 aa, Artificial Sequence
  Synthetic
  BCMA-19 CDR-H2 (aa) AbM numbering
WINPNSGGTN

SEQ ID NO: 174 - protein, 12 aa, Artificial Sequence
  Synthetic
  BCMA-13, -14, -15, -16, -18, -21 CDR-L1 (aa)
GSGSNIGSNDVS

SEQ ID NO: 175 - protein, 11 aa, Artificial Sequence
  Synthetic
  BCMA-17, -33 CDR-L1 (aa)
GGNNIGFKGVQ

SEQ ID NO: 176 - protein, 14 aa, Artificial Sequence
  Synthetic
  BCMA-19 CDR-L1 (aa)
TGTSSDVGDYNYVA

SEQ ID NO: 177 - protein, 7 aa, Artificial Sequence
  Synthetic
  BCMA-20, -27 CDR-L1 (aa)
SGGKTVN

SEQ ID NO: 178 - protein, 14 aa, Artificial Sequence
  Synthetic
  BCMA-22, -23 CDR-L1 (aa)
TGSSSDVGKYNLVS

SEQ ID NO: 179 - protein, 7 aa, Artificial Sequence
  Synthetic
  BCMA-13, -14, -15, -16, -18, -21 CDR-L2 (aa)
WNDQRPS

SEQ ID NO: 180 - protein, 7 aa, Artificial Sequence
  Synthetic
  BCMA-17, -32, -33 CDR-L2 (aa)
DDSDRPS

SEQ ID NO: 181 - protein, 7 aa, Artificial Sequence
  Synthetic
  BCMA-19 CDR-L2 (aa)
EVINRPS

SEQ ID NO: 182 - protein, 7 aa, Artificial Sequence
  Synthetic
  BCMA-20, -27 CDR-L2 (aa)
SNDQRPS

SEQ ID NO: 183 - protein, 7 aa, Artificial Sequence
  Synthetic
  BCMA-22, -23, -40 CDR-L2 (aa)
DVNKRPS

SEQ ID NO: 184 - protein, 12 aa, Artificial Sequence
  Synthetic
  BCMA-13 CDR-L3 (aa)
AAWDDSLGGSWV

SEQ ID NO: 185 - protein, 12 aa, Artificial Sequence
  Synthetic
  BCMA-14 CDR-L3 (aa)
AAWDDRLNGFWV

SEQ ID NO: 186 - protein, 11 aa, Artificial Sequence
  Synthetic
  BCMA-15 CDR-L3 (aa)
AAWDDSLSGWV

SEQ ID NO: 187 - protein, 11 aa, Artificial Sequence
  Synthetic
  BCMA-16 CDR-L3 (aa)
ASWDDSLSGWV

SEQ ID NO: 188 - protein, 11 aa, Artificial Sequence
  Synthetic
  BCMA-17, -33 CDR-L3 (aa)
QVWDSASDHWV

SEQ ID NO: 189 - protein, 11 aa, Artificial Sequence
  Synthetic
  BCMA-18 CDR-L3 (aa)
AAWDDSLNGWV

SEQ ID NO: 190 - protein, 11 aa, Artificial Sequence
  Synthetic
  BCMA-19 CDR-L3 (aa)
ISYSRGSTPYV

SEQ ID NO: 191 - protein, 11 aa, Artificial Sequence
  Synthetic
  BCMA-20, -27 CDR-L3 (aa)
GSWDDSLNAWV

SEQ ID NO: 192 - protein, 11 aa, Artificial Sequence
  Synthetic
  BCMA-21 CDR-L3 (aa)
AAWDDSLNGYV

SEQ ID NO: 193 - protein, 10 aa, Artificial Sequence
  Synthetic
  BCMA-22, -40 CDR-L3 (aa)
CSYGGSRSYV

SEQ ID NO: 194 - protein, 10 aa, Artificial Sequence
  Synthetic
  BCMA-23 CDR-L3 (aa)
SSYGGSRSYV

SEQ ID NO: 195 - protein, 30 aa, Artificial Sequence
  Synthetic
  BCMA-13 VH FR1 (aa)
QMQLVQYGGGVVQPGRSLRLSCAASGFTFS

SEQ ID NO: 196 - protein, 30 aa, Artificial Sequence
  Synthetic
  BCMA-14 VH FR1 (aa)
EVQLLESGGGVVQPGRSLRLSCAASGFTFS

SEQ ID NO: 197 - protein, 30 aa, Artificial Sequence
  Synthetic
  BCMA-15, -47 VH FR1 (aa)
QVQLLESGGGLVKPGGSLRLSCAASGFTFS

SEQ ID NO: 198 - protein, 30 aa, Artificial Sequence
  Synthetic
  BCMA-16 VH FR1 (aa)
EVQLVQSGPEVKKPGTSVKVSCKASGFTFT

SEQ ID NO: 199 - protein, 30 aa, Artificial Sequence
  Synthetic
  BCMA-17, -33, -36, -38, -41 VH FR1 (aa)
QVQLVQSGGGLVKPGGSLRLSCAASGFTFS

SEQ ID NO: 200 - protein, 30 aa, Artificial Sequence
  Synthetic
  BCMA-18 VH FR1 (aa)
EVQLLESGGGLVQPGGSLRLSCAASGFTFS

SEQ ID NO: 201 - protein, 30 aa, Artificial Sequence
  Synthetic
  BCMA-19 VH FR1 (aa)
QVQLVQSGAEVKKPGASVKVSCKASGYTFT

SEQ ID NO: 202 - protein, 30 aa, Artificial Sequence
  Synthetic
  BCMA-20 VH FR1 (aa)
EVQLLESGGGLVQPGRSLRLSCAASGFTFD

SEQ ID NO: 203 - protein, 30 aa, Artificial Sequence
  Synthetic
  BCMA-21 VH FR1 (aa)
EVQLVESGGGLVKPGGSLKLSCAASGFTFS

SEQ ID NO: 204 - protein, 14 aa, Artificial Sequence
  Synthetic
  BCMA-13, -14, -15 VH FR2 (aa)
WVRQAPGKGLEWVA

SEQ ID NO: 205 - protein, 14 aa, Artificial Sequence
  Synthetic
  BCMA-16 VH FR2 (aa)
WVRQARGQRLEWIG

SEQ ID NO: 206 - protein, 14 aa, Artificial Sequence
  Synthetic
  BCMA-17 VH FR2 (aa)
WIRLAPGKGLEWVS

SEQ ID NO: 207 - protein, 14 aa, Artificial Sequence
  Synthetic
  BCMA-18 VH FR2 (aa)
WHRQAPGKGPEWVA

SEQ ID NO: 208 - protein, 14 aa, Artificial Sequence
  Synthetic
  BCMA-19 VH FR2 (aa)
WVRQAPGQGLEWMG

SEQ ID NO: 209 - protein, 14 aa, Artificial Sequence
  Synthetic
  BCMA-20, -27, -28, -29, -30, -34, -39 VH FR2 (aa)
WVRQAPGKGLEWVS

SEQ ID NO: 210 - protein, 32 aa, Artificial Sequence
  Synthetic
  BCMA-13 VH FR3 (aa)
RFTISRDNSKNTLYLQMNSLKAEDTAVYYCAT

SEQ ID NO: 211 - protein, 32 aa, Artificial Sequence
  Synthetic
  BCMA-14 VH FR3 (aa)
RFTISRDNSKNTLYLQMNSLRAEDTAVYYCAT

SEQ ID NO: 212 - protein, 32 aa, Artificial Sequence
  Synthetic
  BCMA-15 VH FR3 (aa)
RFTISRDNSKNTLYLQMNSLRAEDTAVYYCAK

SEQ ID NO: 213 - protein, 32 aa, Artificial Sequence
  Synthetic
  BCMA-16 VH FR3 (aa)
RVTITRDMSTSTAYMELSSLRSEDTAVYYCAA

SEQ ID NO: 214 - protein, 32 aa, Artificial Sequence
  Synthetic
  BCMA-18 VH FR3 (aa)
RFTISRDNAESSLYLQMNSLRAEDTAVYYCAR

SEQ ID NO: 215 - protein, 32 aa, Artificial Sequence
  Synthetic
  BCMA-19 VH FR3 (aa)
RVTMTRDTSISTAYMELSRLRSDDTAVYYCAR

SEQ ID NO: 216 - protein, 32 aa, Artificial Sequence
  Synthetic
  BCMA-20, -27 VH FR3 (aa)
RFTISRDNAKNSLYLQMNSLRAEDTALYYCAK

SEQ ID NO: 217 - protein, 11 aa, Artificial Sequence
  Synthetic
  BCMA-13 VH FR4 (aa)
RGQGTLVTVSS

SEQ ID NO: 218 - protein, 11 aa, Artificial Sequence
  Synthetic
  BCMA-14 VH FR4 (aa)
RGPGTLVTVSS

SEQ ID NO: 219 - protein, 11 aa, Artificial Sequence
  Synthetic
  BCMA-17, -33 VH FR4 (aa)
WGQGTLVNVSS

SEQ ID NO: 220 - protein, 11 aa, Artificial Sequence
  Synthetic
  BCMA-19 VH FR4 (aa)
WGQGTTVTVSS

SEQ ID NO: 221 - protein, 22 aa, Artificial Sequence
  Synthetic
  BCMA-13, -14 VL FR1 (aa)
QAVLTQPPSASGTPGQRVTISC

SEQ ID NO: 222 - protein, 22 aa, Artificial Sequence
  Synthetic
  BCMA-15, -18, -21 VL FR1 (aa)
QSVLTQPPSASGTPGQRVTISC

SEQ ID NO: 223 - protein, 22 aa, Artificial Sequence
  Synthetic
  BCMA-16 VL FR1 (aa)
QSALTQPPSASGTPGQRVTISC

SEQ ID NO: 224 - protein, 22 aa, Artificial Sequence
  Synthetic
  BCMA-17, -33 VL FR1 (aa)
QPVLTQPPSVSVAPGKTAMITC

SEQ ID NO: 225 - protein, 22 aa, Artificial Sequence
  Synthetic
  BCMA-19 VL FR1 (aa)
QAVLTQPASVSGSPGQSITISC

SEQ ID NO: 226 - protein, 22 aa, Artificial Sequence
  Synthetic
  BCMA-20, -27 VL FR1 (aa)
QPVLTQPPSASGTPGQRVTISC

SEQ ID NO: 227 - protein, 22 aa, Artificial Sequence
  Synthetic
  BCMA-22, -23, -40 VL FR1 (aa)
QSALTQPASVSGSPGQSITISC

SEQ ID NO: 228 - protein, 15 aa, Artificial Sequence
  Synthetic
  BCMA-13, -14, -15, -16, -18, -21 VL FR2 (aa)
WYQQIPGTAPKLLIY

SEQ ID NO: 229 - protein, 15 aa, Artificial Sequence
  Synthetic
  BCMA-17, -33 VL FR2 (aa)
WYQQKTGQAPVLVVY

SEQ ID NO: 230 - protein, 15 aa, Artificial Sequence
  Synthetic
  BCMA-19 VL FR2 (aa)
WYQQHPGKDPKLMIF

SEQ ID NO: 231 - protein, 15 aa, Artificial Sequence
  Synthetic
  BCMA-20, -27 VL FR2 (aa)
WFRQVPGTAPQLLIY

SEQ ID NO: 232 - protein, 15 aa, Artificial Sequence
  Synthetic
  BCMA-22, -23, -40 VL FR2 (aa)
WYQQPPGKAPKLIIY

SEQ ID NO: 233 - protein, 32 aa, Artificial Sequence
  Synthetic
  BCMA-13 VL FR3 (aa)
GVPDRFSASKSGTSASLAISGLRSEDEADYYC

SEQ ID NO: 234 - protein, 32 aa, Artificial Sequence
  Synthetic
  BCMA-14 VL FR3 (aa)
GVPDRFSGSKSGASASLAISGLQSEDEADYYC

SEQ ID NO: 235 - protein, 32 aa, Artificial Sequence
  Synthetic
  BCMA-15 VL FR3 (aa)
GVPDRFSGSKSGTSASLVISGLRSEDEADYYC

SEQ ID NO: 236 - protein, 32 aa, Artificial Sequence
  Synthetic
  BCMA-16 VL FR3 (aa)
GVPDRFSGSKSGTSASLAISGLQSEDEADYYC

SEQ ID NO: 237 - protein, 32 aa, Artificial Sequence
  Synthetic
  BCMA-17, -33 VL FR3 (aa)
GIPERFSGSNSGNTATLTISRVEAGDEADYYC

SEQ ID NO: 238 - protein, 32 aa, Artificial Sequence
  Synthetic
  BCMA-18 VL FR3 (aa)
GVPDRFSGSKSGTSASLAISGLRSEDEADYYC

SEQ ID NO: 239 - protein, 32 aa, Artificial Sequence
  Synthetic
  BCMA-19 VL FR3 (aa)
GVSDRFSGSKSGNTASLDISGLQPEDEADYYC

SEQ ID NO: 240 - protein, 32 aa, Artificial Sequence
  Synthetic
  BCMA-20, -27 VL FR3 (aa)
GVPDRFSGSKSGSSASLDISGLQSEDEAYYYC

SEQ ID NO: 241 - protein, 32 aa, Artificial Sequence
  Synthetic
  BCMA-21 VL FR3 (aa)
GVPDRFSGSKSGISASLAISGLRSEDEADYYC

SEQ ID NO: 242 - protein, 32 aa, Artificial Sequence
  Synthetic
  BCMA-22, -23, -40 VL FR3 (aa)
GVSNRFSGSKSGNTATLTISGLQGDDEADYYC

SEQ ID NO: 243 - protein, 10 aa, Artificial Sequence
  Synthetic
  BCMA-13 VL FR4 (aa)
FGGGTKVTVL

SEQ ID NO: 244 - protein, 10 aa, Artificial Sequence
  Synthetic
  BCMA-19 VL FR4 (aa)
IGTGTKVTVL

SEQ ID NO: 245 - protein, 10 aa, Artificial Sequence
  Synthetic
  BCMA-20, -27 VL FR4 (aa)
FGGETKLTVL

SEQ ID NO: 246 - protein, 10 aa, Artificial Sequence
  Synthetic
  BCMA-21, -22, -23 VL FR4 (aa)
FGTGTKVTVL

SEQ ID NO: 247 - protein, 122 aa, Artificial Sequence
  Synthetic
  BCMA-13 VH Chain (aa)
QMQLVQYGGGVVQPGRSLRLSCAASGFTFSSYAMHWVRQAPGKGLEWVAVISYDGSNKYYADSVKGRFTISRDNSKNTLYLQMNSLKAEDTAVYYCATLPGRDGYPGAFDYRGQGTLVTVSS

SEQ ID NO: 248 - protein, 122 aa, Artificial Sequence
  Synthetic
  BCMA-14 VH Chain (aa)
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCATLPGRDGYPGAFDYRGPGTLVTVSS

SEQ ID NO: 249 - protein, 123 aa, Artificial Sequence
  Synthetic
  BCMA-15 VH Chain (aa)
QVQLLESGGGLVKPGGSLRLSCAASGFTFSSYGMHWVRQAPGKGLEWVAVISYDGSNKYYADSVKGRFTISRDNSKNTLYLQMNSLRAEDTAVYYCAKDQYSSSAQRADFDYWGQGTLVTVSS

SEQ ID NO: 250 - protein, 121 aa, Artificial Sequence
  Synthetic
  BCMA-16 VH Chain (aa)
EVQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAAPYYDILTGYYLWGQGTLVTVSS

SEQ ID NO: 251 - protein, 117 aa, Artificial Sequence
  Synthetic
  BCMA-17 VH Chain (aa)
QVQLVQSGGGLVKPGGSLRLSCAASGFTFSDYYMSWIRLAPGKGLEWVSYISSSGSTIYYADSVKGRFTISRDNAKNSLYLQMNSLRAEDTAVYYCAREADSSADYWGQGTLVNVSS

SEQ ID NO: 252 - protein, 115 aa, Artificial Sequence
  Synthetic
  BCMA-18 VH Chain (aa)
EVQLLESGGGLVQPGGSLRLSCAASGFTFSSYWMSWHRQAPGKGPEWVAHINQDGSEKYYVDSVKGRFTISRDNAESSLYLQMNSLRAEDTAVYYCARWLAVTNWGQGTLVTVSS

SEQ ID NO: 253 - protein, 114 aa, Artificial Sequence
  Synthetic
  BCMA-19 VH Chain (aa)
QVQLVQSGAEVKKPGASVKVSCKASGYTFTSYYMHWVRQAPGQGLEWMGWINPNSGGTNYAQKFQGRVTMTRDTSISTAYMELSRLRSDDTAVYYCARDGGDVWGQGTTVTVSS

SEQ ID NO: 254 - protein, 121 aa, Artificial Sequence
  Synthetic
  BCMA-20 VH Chain (aa)
EVQLLESGGGLVQPGRSLRLSCAASGFTFDDYAMHWVRQAPGKGLEWVSGISWNSGSIGYADSVKGRFTISRDNAKNSLYLQMNSLRAEDTALYYCAKGGLGITPYYFDYWGQGTLVTVSS

SEQ ID NO: 255 - protein, 118 aa, Artificial Sequence
  Synthetic
  BCMA-21 VH Chain (aa)
EVQLVESGGGLVKPGGSLKLSCAASGFTFSDYYMSWIRQAPGKGLEWVSYISSSGSTIYYADSVKGRFTISRDNAKNSLYLQMNSLRAEDTAVYYCAKVDGGYTEDYWGQGTLVTVSS

SEQ ID NO: 256 - protein, 118 aa, Artificial Sequence
  Synthetic
  BCMA-22, -23, -40 VH Chain (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGDYTEDYWGQGTLVTVSS

SEQ ID NO: 257 - protein, 111 aa, Artificial Sequence
  Synthetic
  BCMA-13 VL Chain (aa)
QAVLTQPPSASGTPGQRVTISCSGSGSNIGSNDVSWYQQIPGTAPKLLIYWNDQRPSGVPDRFSASKSGTSASLAISGLRSEDEADYYCAAWDDSLGGSWVFGGGTKVTVL

SEQ ID NO: 258 - protein, 111 aa, Artificial Sequence
  Synthetic
  BCMA-14 VL Chain (aa)
QAVLTQPPSASGTPGQRVTISCSGSGSNIGSNDVSWYQQIPGTAPKLLIYWNDQRPSGVPDRFSGSKSGASASLAISGLQSEDEADYYCAAWDDRLNGFWVFGGGTKLTVL

SEQ ID NO: 259 - protein, 110 aa, Artificial Sequence
  Synthetic
  BCMA-15 VL Chain (aa)
QSVLTQPPSASGTPGQRVTISCSGSGSNIGSNDVSWYQQIPGTAPKLLIYWNDQRPSGVPDRFSGSKSGTSASLVISGLRSEDEADYYCAAWDDSLSGWVFGGGTKLTVL

SEQ ID NO: 260 - protein, 110 aa, Artificial Sequence
  Synthetic
  BCMA-16 VL Chain (aa)
QSALTQPPSASGTPGQRVTISCSGSGSNIGSNDVSWYQQIPGTAPKLLIYWNDQRPSGVPDRFSGSKSGTSASLAISGLQSEDEADYYCASWDDSLSGWVFGGGTKLTVL

SEQ ID NO: 261 - protein, 108 aa, Artificial Sequence
  Synthetic
  BCMA-17, -33 VL Chain (aa)
QPVLTQPPSVSVAPGKTAMITCGGNNIGFKGVQWYQQKTGQAPVLVVYDDSDRPSGIPERFSGSNSGNTATLTISRVEAGDEADYYCQVWDSASDHWVFGGGTKLTVL

SEQ ID NO: 262 - protein, 110 aa, Artificial Sequence
  Synthetic
  BCMA-18 VL Chain (aa)
QSVLTQPPSASGTPGQRVTISCSGSGSNIGSNDVSWYQQIPGTAPKLLIYWNDQRPSGVPDRFSGSKSGTSASLAISGLRSEDEADYYCAAWDDSLNGWVFGGGTKLTVL

SEQ ID NO: 263 - protein, 111 aa, Artificial Sequence
  Synthetic
  BCMA-19 VL Chain (aa)
QAVLTQPASVSGSPGQSITISCTGTSSDVGDYNYVAWYQQHPGKDPKLMIFEVINRPSGVSDRFSGSKSGNTASLDISGLQPEDEADYYCISYSRGSTPYVIGTGTKVTVL

SEQ ID NO: 264 - protein, 104 aa, Artificial Sequence
  Synthetic
  BCMA-20, -27 VL Chain (aa)
QPVLTQPPSASGTPGQRVTISCSGGKTVNWFRQVPGTAPQLLIYSNDQRPSGVPDRFSGSKSGSSASLDISGLQSEDEAYYYCGSWDDSLNAWVFGGETKLTVL

SEQ ID NO: 265 - protein, 110 aa, Artificial Sequence
  Synthetic
  BCMA-21 VL Chain (aa)
QSVLTQPPSASGTPGQRVTISCSGSGSNIGSNDVSWYQQIPGTAPKLLIYWNDQRPSGVPDRFSGSKSGISASLAISGLRSEDEADYYCAAWDDSLNGYVFGTGTKVTVL

SEQ ID NO: 266 - protein, 110 aa, Artificial Sequence
  Synthetic
  BCMA-22 VL Chain (aa)
QSALTQPASVSGSPGQSITISCTGSSSDVGKYNLVSWYQQPPGKAPKLIIYDVNKRPSGVSNRFSGSKSGNTATLTISGLQGDDEADYYCCSYGGSRSYVFGTGTKVTVL

SEQ ID NO: 267 - protein, 110 aa, Artificial Sequence
  Synthetic
  BCMA-23 VL Chain (aa)
QSALTQPASVSGSPGQSITISCTGSSSDVGKYNLVSWYQQPPGKAPKLIIYDVNKRPSGVSNRFSGSKSGNTATLTISGLQGDDEADYYCSSYGGSRSYVFGTGTKVTVL

SEQ ID NO: 268 - protein, 248 aa, Artificial Sequence
  Synthetic
  BCMA-13 scFv (aa)
QMQLVQYGGGVVQPGRSLRLSCAASGFTFSSYAMHWVRQAPGKGLEWVAVISYDGSNKYYADSVKGRFTISRDNSKNTLYLQMNSLKAEDTAVYYCATLPGRDGYPGAFDYRGQGTLVTVSSGGGGSGGGGSGGGGSQAVLTQPPSASGTPGQRVTISCSGSGSNIGSNDVSWYQQIPGTAPKLLIYWNDQRPSGVPDRFSASKSGTSASLAISGLRSEDEADYYCAAWDDSLGGSWVFGGGTKVTVL

SEQ ID NO: 269 - protein, 248 aa, Artificial Sequence
  Synthetic
  BCMA-14 scFv (aa)
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCATLPGRDGYPGAFDYRGPGTLVTVSSGGGGSGGGGSGGGGSQAVLTQPPSASGTPGQRVTISCSGSGSNIGSNDVSWYQQIPGTAPKLLIYWNDQRPSGVPDRFSGSKSGASASLAISGLQSEDEADYYCAAWDDRLNGFWVFGGGTKLTVL

SEQ ID NO: 270 - protein, 248 aa, Artificial Sequence
  Synthetic
  BCMA-15 scFv (aa)
QVQLLESGGGLVKPGGSLRLSCAASGFTFSSYGMHWVRQAPGKGLEWVAVISYDGSNKYYADSVKGRFTISRDNSKNTLYLQMNSLRAEDTAVYYCAKDQYSSSAQRADFDYWGQGTLVTVSSGGGGSGGGGSGGGGSQSVLTQPPSASGTPGQRVTISCSGSGSNIGSNDVSWYQQIPGTAPKLLIYWNDQRPSGVPDRFSGSKSGTSASLVISGLRSEDEADYYCAAWDDSLSGWVFGGGTKLTVL

SEQ ID NO: 271 - protein, 246 aa, Artificial Sequence
  Synthetic
  BCMA-16 scFv (aa)
EVQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAAPYYDILTGYYLWGQGTLVTVSSGGGGSGGGGSGGGGSQSALTQPPSASGTPGQRVTISCSGSGSNIGSNDVSWYQQIPGTAPKLLIYWNDQRPSGVPDRFSGSKSGTSASLAISGLQSEDEADYYCASWDDSLSGWVFGGGTKLTVL

SEQ ID NO: 272 - protein, 240 aa, Artificial Sequence
  Synthetic
  BCMA-17 scFv (aa)
QVQLVQSGGGLVKPGGSLRLSCAASGFTFSDYYMSWIRLAPGKGLEWVSYISSSGSTIYYADSVKGRFTISRDNAKNSLYLQMNSLRAEDTAVYYCAREADSSADYWGQGTLVNVSSGGGGSGGGGSGGGGSQPVLTQPPSVSVAPGKTAMITCGGNNIGFKGVQWYQQKTGQAPVLVVYDDSDRPSGIPERFSGSNSGNTATLTISRVEAGDEADYYCQVWDSASDHWVFGGGTKLTVL

SEQ ID NO: 273 - protein, 240 aa, Artificial Sequence
  Synthetic
  BCMA-18 scFv (aa)
EVQLLESGGGLVQPGGSLRLSCAASGFTFSSYWMSWHRQAPGKGPEWVAHINQDGSEKYYVDSVKGRFTISRDNAESSLYLQMNSLRAEDTAVYYCARWLAVTNWGQGTLVTVSSGGGGSGGGGSGGGGSQSVLTQPPSASGTPGQRVTISCSGSGSNIGSNDVSWYQQIPGTAPKLLIYWNDQRPSGVPDRFSGSKSGTSASLAISGLRSEDEADYYCAAWDDSLNGWVFGGGTKLTVL

SEQ ID NO: 274 - protein, 240 aa, Artificial Sequence
  Synthetic
  BCMA-19 scFv (aa)
QVQLVQSGAEVKKPGASVKVSCKASGYTFTSYYMHWVRQAPGQGLEWMGWINPNSGGTNYAQKFQGRVTMTRDTSISTAYMELSRLRSDDTAVYYCARDGGDVWGQGTTVTVSSGGGGSGGGGSGGGGSQAVLTQPASVSGSPGQSITISCTGTSSDVGDYNYVAWYQQHPGKDPKLMIFEVINRPSGVSDRFSGSKSGNTASLDISGLQPEDEADYYCISYSRGSTPYVIGTGTKVTVL

SEQ ID NO: 275 - protein, 240 aa, Artificial Sequence
  Synthetic
  BCMA-20 scFv (aa)
EVQLLESGGGLVQPGRSLRLSCAASGFTFDDYAMHWVRQAPGKGLEWVSGISWNSGSIGYADSVKGRFTISRDNAKNSLYLQMNSLRAEDTALYYCAKGGLGITPYYFDYWGQGTLVTVSSGGGGSGGGGSGGGGSQPVLTQPPSASGTPGQRVTISCSGGKTVNWFRQVPGTAPQLLIYSNDQRPSGVPDRFSGSKSGSSASLDISGLQSEDEAYYYCGSWDDSLNAWVFGGETKLTVL

SEQ ID NO: 276 - protein, 243 aa, Artificial Sequence
  Synthetic
  BCMA-21 scFv (aa)
EVQLVESGGGLVKPGGSLKLSCAASGFTFSDYYMSWIRQAPGKGLEWVSYISSSGSTIYYADSVKGRFTISRDNAKNSLYLQMNSLRAEDTAVYYCAKVDGGYTEDYWGQGTLVTVSSGGGGSGGGGSGGGGSQSVLTQPPSASGTPGQRVTISCSGSGSNIGSNDVSWYQQIPGTAPKLLIYWNDQRPSGVPDRFSGSKSGISASLAISGLRSEDEADYYCAAWDDSLNGYVFGTGTKVTVL

SEQ ID NO: 277 - protein, 243 aa, Artificial Sequence
  Synthetic
  BCMA-22 scFv (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGDYTEDYWGQGTLVTVSSGGGGSGGGGSGGGGSQSALTQPASVSGSPGQSITISCTGSSSDVGKYNLVSWYQQPPGKAPKLIIYDVNKRPSGVSNRFSGSKSGNTATLTISGLQGDDEADYYCCSYGGSRSYVFGTGTKVTVL

SEQ ID NO: 278 - protein, 243 aa, Artificial Sequence
  Synthetic
  BCMA-23 scFv (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGDYTEDYWGQGTLVTVSSGGGGSGGGGSGGGGSQSALTQPASVSGSPGQSITISCTGSSSDVGKYNLVSWYQQPPGKAPKLIIYDVNKRPSGVSNRFSGSKSGNTATLTISGLQGDDEADYYCSSYGGSRSYVFGTGTKVTVL

SEQ ID NO: 279 - protein, 9 aa, Artificial Sequence
  Synthetic
  VH-3 CDR-H3 (aa)
VDGDDAFDI

SEQ ID NO: 280 - protein, 13 aa, Artificial Sequence
  Synthetic
  VH-4 CDR-H3 (aa)
DPLSWDSSGKGPR

SEQ ID NO: 281 - protein, 16 aa, Artificial Sequence
  Synthetic
  VH-5 CDR-H3 (aa)
ENYDFWSWRYYYDMDV

SEQ ID NO: 282 - protein, 9 aa, Artificial Sequence
  Synthetic
  VH-6 CDR-H3 (aa)
VDGPPSYDI

SEQ ID NO: 283 - protein, 9 aa, Artificial Sequence
  Synthetic
  VH-7 CDR-H3 (aa)
GDWDDAFDI

SEQ ID NO: 284 - protein, 8 aa, Artificial Sequence
  Synthetic
  VH-9 CDR-H3 (aa)
VDGDYEDY

SEQ ID NO: 285 - protein, 12 aa, Artificial Sequence
  Synthetic
  VH-10 CDR-H3 (aa)
DVPSSGDDAFDI

SEQ ID NO: 286 - protein, 9 aa, Artificial Sequence
  Synthetic
  VH-11 CDR-H3 (aa)
VDGDDVFDI

SEQ ID NO: 287 - protein, 8 aa, Artificial Sequence
  Synthetic
  VH-12 CDR-H3 (aa)
VDGDAFDI

SEQ ID NO: 288 - protein, 5 aa, Artificial Sequence
  Synthetic
  BCMA-C1 VH CDR-H1 (aa)
DYSIN

SEQ ID NO: 289 - protein, 5 aa, Artificial Sequence
  Synthetic
  BCMA-C2 VH CDR-H1 (aa)
NFGMN

SEQ ID NO: 290 - protein, 17 aa, Artificial Sequence
  Synthetic
  BCMA-C1 VH CDR-H2 (aa)
WINTETREPAYAYDFRG

SEQ ID NO: 291 - protein, 17 aa, Artificial Sequence
  Synthetic
  BCMA-C2 VH CDR-H2 (aa)
WINTYTGESYFADDFKG

SEQ ID NO: 292 - protein, 8 aa, Artificial Sequence
  Synthetic
  BCMA-C1 VH CDR-H3 (aa)
DYSYAMDY

SEQ ID NO: 293 - protein, 13 aa, Artificial Sequence
  Synthetic
  BCMA-C2 VH CDR-H3 (aa)
GEIYYGYDGGFAY

SEQ ID NO: 294 - protein, 7 aa, Artificial Sequence
  Synthetic
  BCMA-C1 VH CDR-H1 (aa) Chothia numbering
GYTFTDY

SEQ ID NO: 295 - protein, 7 aa, Artificial Sequence
  Synthetic
  BCMA-C2 VH CDR-H1 (aa) Chothia numbering
GYTFTNF

SEQ ID NO: 296 - protein, 6 aa, Artificial Sequence
  Synthetic
  BCMA-C1 VH CDR-H2 (aa) Chothia numbering
NTETRE

SEQ ID NO: 297 - protein, 6 aa, Artificial Sequence
  Synthetic
  BCMA-C2 VH CDR-H2 (aa) Chothia numbering
NTYTGE

SEQ ID NO: 298 - protein, 10 aa, Artificial Sequence
  Synthetic
  BCMA-C1 VH CDR-H1 (aa) AbM numbering
GYTFTDYSIN

SEQ ID NO: 299 - protein, 10 aa, Artificial Sequence
  Synthetic
  BCMA-C2 VH CDR-H1 (aa) AbM numbering
GYTFTNFGMN

SEQ ID NO: 300 - protein, 10 aa, Artificial Sequence
  Synthetic
  BCMA-C1 VH CDR-H2 (aa) AbM numbering
WINTETREPA

SEQ ID NO: 301 - protein, 10 aa, Artificial Sequence
  Synthetic
  BCMA-C2 VH CDR-H2 (aa) AbM numbering
WINTYTGESY

SEQ ID NO: 302 - protein, 15 aa, Artificial Sequence
  Synthetic
  BCMA-C1 VL CDR-L1 (aa)
RASESVTILGSHLIH

SEQ ID NO: 303 - protein, 11 aa, Artificial Sequence
  Synthetic
  BCMA-C2 VL CDR-L1 (aa)
RASQDVNTAVS

SEQ ID NO: 304 - protein, 7 aa, Artificial Sequence
  Synthetic
  BCMA-C1 VL CDR-L2 (aa)
LASNVQT

SEQ ID NO: 305 - protein, 7 aa, Artificial Sequence
  Synthetic
  BCMA-C2 VL CDR-L2 (aa)
SASYRYT

SEQ ID NO: 306 - protein, 9 aa, Artificial Sequence
  Synthetic
  BCMA-C1 VL CDR-L3 (aa)
LQSRTIPRT

SEQ ID NO: 307 - protein, 9 aa, Artificial Sequence
  Synthetic
  BCMA-C2 VL CDR-L3 (aa)
QQHYSTPWT

SEQ ID NO: 308 - protein, 30 aa, Artificial Sequence
  Synthetic
  BCMA-C1 VH FR1 (aa)
QIQLVQSGPELKKPGETVKISCKASGYTFT

SEQ ID NO: 309 - protein, 30 aa, Artificial Sequence
  Synthetic
  BCMA-C2 VH FR1 (aa)
QIQLVQSGPDLKKPGETVKLSCKASGYTFT

SEQ ID NO: 310 - protein, 14 aa, Artificial Sequence
  Synthetic
  BCMA-C1 VH FR2 (aa)
WVKRAPGKGLKWMG

SEQ ID NO: 311 - protein, 14 aa, Artificial Sequence
  Synthetic
  BCMA-C2 VH FR2 (aa)
WVKQAPGKGFKWMA

SEQ ID NO: 312 - protein, 32 aa, Artificial Sequence
  Synthetic
  BCMA-C1 VH FR3 (aa)
RFAFSLETSASTAYLQINNLKYEDTATYFCAL

SEQ ID NO: 313 - protein, 32 aa, Artificial Sequence
  Synthetic
  BCMA-C2 VH FR3 (aa)
RFAFSVETSATTAYLQINNLKTEDTATYFCAR

SEQ ID NO: 314 - protein, 11 aa, Artificial Sequence
  Synthetic
  BCMA-C1 VH FR4 (aa)
WGQGTSVTVSS

SEQ ID NO: 315 - protein, 11 aa, Artificial Sequence
  Synthetic
  BCMA-C2 VH FR4 (aa)
WGQGTLVTVSA

SEQ ID NO: 316 - protein, 23 aa, Artificial Sequence
  Synthetic
  BCMA-C1 VL FR1 (aa)
DIVLTQSPPSLAMSLGKRATISC

SEQ ID NO: 317 - protein, 23 aa, Artificial Sequence
  Synthetic
  BCMA-C2 VL FR1 (aa)
DVVMTQSHRFMSTSVGDRVSITC

SEQ ID NO: 318 - protein, 15 aa, Artificial Sequence
  Synthetic
  BCMA-C1 VL FR2 (aa)
WYQQKPGQPPTLLIQ

SEQ ID NO: 319 - protein, 15 aa, Artificial Sequence
  Synthetic
  BCMA-C2 VL FR2 (aa)
WYQQKPGQSPKLLIF

SEQ ID NO: 320 - protein, 32 aa, Artificial Sequence
  Synthetic
  BCMA-C1 VL FR3 (aa)
GVPARFSGSGSRTDFTLTIDPVEEDDVAVYYC

SEQ ID NO: 321 - protein, 32 aa, Artificial Sequence
  Synthetic
  BCMA-C2 VL FR3 (aa)
GVPDRFTGSGSGADFTLTISSVQAEDLAVYYC

SEQ ID NO: 322 - protein, 10 aa, Artificial Sequence
  Synthetic
  BCMA-C1 VL FR4 (aa)
FGGGTKLEIK

SEQ ID NO: 323 - protein, 10 aa, Artificial Sequence
  Synthetic
  BCMA-C2 VL FR4 (aa)
FGGGTKLDIK

SEQ ID NO: 324 - protein, 117 aa, Artificial Sequence
  Synthetic
  BCMA-C1 VH Chain (aa)
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 325 - protein, 122 aa, Artificial Sequence
  Synthetic
  BCMA-C2 VH Chain (aa)
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 326 - protein, 111 aa, Artificial Sequence
  Synthetic
  BCMA-C1 VL Chain (aa)
DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK

SEQ ID NO: 327 - protein, 107 aa, Artificial Sequence
  Synthetic
  BCMA-C2 VL Chain (aa)
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 328 - protein, 243 aa, Artificial Sequence
  Synthetic
  BCMA-C1 VL-VH scFv (aa)
DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 329 - protein, 244 aa, Artificial Sequence
  Synthetic
  BCMA-C2  VH-VL scFv (aa)
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 330 - DNA, 738 bp, Artificial Sequence
  Synthetic
  BCMA-1 scFv (nt)
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtgcggcctggagtgccccgactgactactggggccagggaaccctggtcaccgtctcctcaggtggaggcggttcaggcggaggtggctctggcggtggcggatcggatattgtgatgacccagtctccagactccctgtctgtgtctccgggcgagagggccaccatcagctgcaagtccagccagagtgttttatccacctccaacaataagaactatttagcttggtatcagcagaaaccaggacagccccctaggctgctcctttactgggcatctacccgggaggccggggtccctgaccgattcagtggcagcgggtctgggacagatttcactctcaccatcagcagcctgcaggctgaagatgtggcggtttattactgtcaacaatatttcagttctccgtacacttttggccacgggaccaagctggaaatcaaa

SEQ ID NO: 331 - DNA, 717 bp, Artificial Sequence
  Synthetic
  BCMA-2 scFv (nt)
gaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaaagtggatggccctccttcttctgatatctggggccaagggacaatggtcaccgtctcctcaggtggaggcggttcaggcggaggtggctctggcggtggcggatcggaaatagtgatgacgcagtctccagccaccctgtctgtgtctccaggggaaacagccaccctctcctgcagggccagtcagagtattaagaccaacttggcctggtaccagcagaaacctggccaggctcccaggctcctcatctatgctgcatccaccagggccactggcatcccagacagattcagtggcagtgggtctgggacagacttcactctcaccatcaccagactggagcctgaagattttgcagtgtattactgtcagcaatatggtagctcacccacttttggccgggggaccaagctggaaatcaaa

SEQ ID NO: 332 - DNA, 738 bp, Artificial Sequence
  Synthetic
  BCMA-3 scFv (nt)
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtgcggcctggagtgccccgactgactactggggccagggaaccctggtcaccgtctcctcaggtggaggcggttcaggcggaggtggctctggcggtggcggatcggatattgtgatgacccagtctccagactccctggttgtgtctctgggcgagagggccaccatcaactgcaagtccagccagagtgttttacacagctccaacaataagaattacttagcttggtaccagcagaaaccaggacagcctcctaagctgctcatttactgggcatctacccgggaatccggggtccctgaccggttcagtggcagcgggtctgggacagatttcactctcaccatcagcagcctgcaggctgaagatgtggcagtttattactgtcagcagtattatactactccgctcactttcggcggagggaccaaggtggaaatcaaa

SEQ ID NO: 333 - DNA, 720 bp, Artificial Sequence
  Synthetic
  BCMA-4 scFv (nt)
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtgcggcctggagtgccccgactgactactggggccagggaaccctggtcaccgtctcctcaggtggaggcggttcaggcggaggtggctctggcggtggcggatcggccatccggatgacccagtctccatcctccctgtccgcgtctctgggggacagagtcaccatcacttgccgggcgagtcaggacattaggaattctttggcctggtatcagcagaggccagggaaagcccctaaactcctgctttctgctgcatccagattggaaagtggggtcccttctaggttcagtggcactacttctggggcggagtatgctctcagcatcagcagcctgcagcctgaagatgtcgcatcttatttctgtcagcagtattatagtctccctctctccttcggcggagggaccaaggtggaaatcaaa

SEQ ID NO: 334 - DNA, 738 bp, Artificial Sequence
  Synthetic
  BCMA-5 scFv (nt)
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtgcggcctggagtgccccgactgactactggggccagggaaccctggtcaccgtctcctcaggtggaggcggttcaggcggaggtggctctggcggtggcggatcggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggatatcaaa

SEQ ID NO: 335 - DNA, 720 bp, Artificial Sequence
  Synthetic
  BCMA-6 scFv (nt)
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtgcggcctggagtgccccgactgactactggggccagggaaccctggtcaccgtctcctcaggtggaggcggttcaggcggaggtggctctggcggtggcggatcggatattgtgatgacccagtctccatcgtccctgtctgtgtctgtaggagagagagtcaccatcacttgtcgggcgagtcagtctataagtaattccttagcctggtataaacagagaccgggagaagcccctaaactcctgatacatgctgcatccaatgtggaagatggggtcccttcgaggttcagcggcaggggatctgggacagttttcactctcgccatcagcaatgtacagcctgaagatttcgcaacttactactgtcagcagagtcacatgtaccctccgactttcggcggggggaccaaggtggaaatcaaa

SEQ ID NO: 336 - DNA, 720 bp, Artificial Sequence
  Synthetic
  BCMA-7 scFv (nt)
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtgcggcctggagtgccccgactgactactggggccagggaaccctggtcaccgtctcctcaggtggaggcggttcaggcggaggtggctctggcggtggcggatcggtcatccagttgacccagtctccctcctcactgtctgcatctgtaggggacagagtcaccatcacttgtcgggcgagtcaggacattggcgattatttagcctggtttcagcagagaccagggaaagcccctaagtccctgatctatgttgcgtccactttgcagagtggggtcccatcaaggttcagcggcagtggatctgggacacacttcactctcaccatcaacagcctgcagcctgaagattttgcaacttattactgccaacagtatcatagtcacccgtggacgttcggcccagggaccaaggtggatatcaaa

SEQ ID NO: 337 - DNA, 738 bp, Artificial Sequence
  Synthetic
  BCMA-8 scFv (nt)
caggtccagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtgcggcctggagtgccccgactgactactggggccagggaaccctggtcaccgtctcctcaggtggaggcggttcaggcggaggtggctctggcggtggcggatcggatattgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggaaatcaaa

SEQ ID NO: 338 - DNA, 723 bp, Artificial Sequence
  Synthetic
  BCMA-9 scFv (nt)
gaagtgcagctggtgcagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagtggacggtgactacgtcgatgactactggggccagggaaccctggtcaccgtctcctcaggtggaggcggttcaggcggaggtggctctggcggtggcggatcgtcctatgagctgactcagccgccctcggtgtctgtggccccaggacagacggccagggttacctgtggggcaaataatattggaagcaaaagtgtccactggtaccagcagaagccaggccaggcccccatgctggtcgtctatgatgatgacgaccggccctccgggatccctgagcgattctctggctccaactctgggaacacggccaccctgaccatcagcggggtcgaggccggggatgaggccgactacttctgtcacgtgtgggatagaagtcgtgatcattatgtcttcggaactgggaccaagctgaccgtccta

SEQ ID NO: 339 - DNA, 723 bp, Artificial Sequence; identical to SEQ ID NO: 338
  Synthetic
  BCMA-10 scFv (nt)

SEQ ID NO: 340 - DNA, 741 bp, Artificial Sequence
  Synthetic
  BCMA-11 scFv (nt)
caggtgcagctggtacagtctgggggaggcttggtacagcctggcaggtccctgagactctcctgtgcagcctctggattcacctttgatgattatgccatgcactgggtccggcgagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccgtgtattactgtgcgagagatctggggcccgactacgatcccgatgcttttgatatctggggccaagggacaatggtcaccgtttcctcaggtggaggcggttcaggcggaggtggctctggcggtggcggatcgcagcttgtgctgactcagccaccctcagcgtctgggacccccgggcagagggtcaccatctcttgttctggaagcagctccaacatcggaagtaatgctgtaaactggtaccagcagctcccaggaacggcccccgaagtcctcatctataatagtcatcagcggccctcaggggtccctgaccgattctctggctccaagtctggcacctcagcctccctggccatcaatgggctccagtctgaggacgaggctgattattactgtgcagcatgggatgacagcctgagaggttacgtcttcggaactgggaccaagctcaccgtccta

SEQ ID NO: 341 - DNA, 729 bp, Artificial Sequence
  Synthetic
  BCMA-12 scFv (nt)
gaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaaagtggatggccctccttcttttgatatctggggccaagggacaatggtcaccgtctcctcaggtggaggcggttcaggcggaggtggctctggcggtggcggatcgcagtctgccctgacgcagccgccctcagtgtctgcggccccaggacagaaggtcaccatctcctgctctggaagccgctccaacattgggaataattatgtatcctggtaccaacagctcccaggaacagcccccaaactcctcatttatgacaatgctaagcgaccctcaggaattcctgaccgattctctggctccaagtctggcacgtcagccaccctggacatcgccggactccagactggggatgaggccgactattactgtcaggtgtgggatagtagtagtgatcattgggtattcggcggagggaccaagctcaccgtccta

SEQ ID NO: 342 - DNA, 744 bp, Artificial Sequence
  Synthetic
  BCMA-13 scFv (nt)
cagatgcagctggtgcagtatgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgaaagctgaggacacggctgtgtattactgtgctaccctacccggtagagatggctaccccggagcctttgactacaggggccagggaaccctggtcaccgtctcctcaggtggaggcggttcaggcggaggtggctctggcggtggcggatcgcaggctgtgctgactcagccaccctcagcgtctgggacccccgggcagagggtcaccatctcttgttctggaagcggctccaacatcggaagtaatgatgtctcctggtatcagcagatcccaggaacggcccccaaactcctcatctactggaatgatcagcggccctcaggggtccctgaccgattctctgcctccaagtctggcacctcagcctccctggccatcagtgggctccggtccgaggatgaggctgattattactgtgcagcatgggatgacagcctgggtggttcttgggtgttcggcggagggaccaaggtcaccgtccta

SEQ ID NO: 343 - DNA, 744 bp, Artificial Sequence
  Synthetic
  BCMA-14 scFv (nt)
gaggtgcagctgttggagtctgggggaggcgtggtccagcctgggaggtccctgagactctcctgtgcagcgtctggattcaccttcagtagctatggcatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgctaccctacccggtagagatggctaccccggagcctttgactacaggggcccgggaaccctggtcaccgtctcctcaggtggaggcggttcaggcggaggtggctctggcggtggcggatcgcaggctgtgctgactcagccaccctcagcgtctgggacccccgggcagagggtcaccatctcttgttctggaagcggctccaacatcggaagtaatgatgtctcctggtatcagcagatcccaggaacggcccccaaactcctcatctactggaatgatcagcggccctcaggggtccctgaccgattctctggctccaagtctggcgcctcagcctctctggccatcagtgggctccagtctgaggatgaggctgattattattgtgcagcatgggatgacaggttgaacggtttttgggtgttcggcggagggaccaagctcaccgtccta

SEQ ID NO: 344 - DNA, 744 bp, Artificial Sequence
  Synthetic
  BCMA-15 scFv (nt)
caggtgcagctgttggagtctgggggaggcctggtcaagcctggggggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatcagtatagcagtagcgcacaaagggccgactttgactactggggccagggaaccctggtcaccgtctcctcaggtggaggcggttcaggcggaggtggttctggcggtggcggatcgcagtctgtgctgacgcagccaccctcagcgtctgggacccccgggcagagggtcaccatctcttgttctggaagcggctccaacatcggaagtaatgatgtctcctggtatcagcagatcccaggaacggcccccaaactcctcatctactggaatgatcagcggccctcaggggtccctgaccggttctcaggctccaagtctggcacctcagcctccctggtcatcagtgggctccggtccgaggatgaggctgattattactgtgcagcatgggatgacagcctgagtggttgggtgttcggcggagggaccaagctgaccgtccta

SEQ ID NO: 345 - DNA, 738 bp, Artificial Sequence
  Synthetic
  BCMA-16 scFv (nt)
gaggtccagctggtacagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagctccgtattacgatattttgactggttattatttatggggccagggaacgctggtcaccgtctcctcaggtggaggcggttctggcggaggtggctctggcggtggcggatcgcagtctgccctgactcagccaccctcagcgtctgggacccccgggcagagggtcaccatctcttgttctggaagcggctccaacatcggaagtaatgatgtctcctggtatcagcagatcccaggaacggcccccaaactcctcatctactggaatgatcagcggccctcaggggtccctgaccgattctctggctccaagtctggcacctcagcctccctggccatcagtgggctccagtctgaggatgaggctgattattactgtgcatcatgggatgacagcctgagtggttgggtgttcggcggagggaccaagctgaccgtccta

SEQ ID NO: 346 - DNA, 720 bp, Artificial Sequence
  Synthetic
  BCMA-17 scFv (nt)
caggttcagctggtgcagtctgggggaggcttggtcaagcctggagggtccctgagactctcctgtgcagcctctggattcaccttcagtgactactacatgagctggatccgcctggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggccgatagtagcgctgactactggggccagggaaccctggtcaacgtctcctcaggtggaggcggttcaggcggaggtggctctggcggtggcggatcgcagcctgtgctgactcagccaccctcggtgtcagtggccccaggaaagacggccatgattacctgtgggggaaacaacattggatttaaaggtgtgcagtggtaccagcagaagacaggccaggcccctgtgctggtcgtctatgatgatagcgaccggccctcagggatccctgagcgattctctggctccaactctgggaacacggccaccctgaccatcagcagggtcgaagccggggatgaggccgattattactgtcaggtgtgggatagtgctagtgatcattgggtgttcggcggagggaccaagctgaccgtccta

SEQ ID NO: 347 - DNA, 720 bp, Artificial Sequence
  Synthetic
  BCMA-18 scFv (nt)
gaggtgcagctgttggagtctgggggaggcttggtccagcctggggggtccctgagactctcctgtgcagcctctggattcacgtttagtagctattggatgagctggcaccgccaggctccagggaaggggccggagtgggtggcccacataaaccaagacggaagtgagaagtactatgtggactctgtgaagggccgattcaccatctccagagacaacgccgagagttcactgtatctgcaaatgaacagcctgagagccgaggacacggctgtgtattactgtgcgaggtggctggcggttactaactggggccagggaaccctggtcaccgtctcctcaggtggaggcggttcaggcggaggtggctctggcggtggcggatcgcagtctgtgttgactcagccaccctcagcgtctgggacccccgggcagagggtcaccatctcttgttctggaagcggctccaacatcggaagtaatgatgtctcctggtatcagcagatcccagggacggcccccaaactcctcatctactggaatgatcagcggccctcaggggtccctgaccgattctctggctccaagtctggcacctcagcctccctggccatcagtgggctccggtccgaggatgaggctgattattactgtgcagcatgggatgacagcctgaatggttgggtgttcggcggagggaccaagctgaccgtccta

SEQ ID NO: 348 - DNA, 720 bp, Artificial Sequence
  Synthetic
  BCMA-19 scFv (nt)
caggtccagctggtacagtctggggctgaggtgaagaagcctggggcctcagtgaaggtctcctgcaaggcttctggatacaccttcaccagctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagatggtggggacgtctggggccaagggaccacggtcaccgtctcctcaggtggaggcggttcaggcggaggtggctctggcggtggcggatcgcaggctgtgctgactcagcctgcctccgtgtctgggtctcctggacagtcgatcaccatctcctgcactggaaccagcagtgacgttggtgattataactatgtcgcctggtatcaacaacacccaggcaaagaccccaaactcatgatttttgaggtcattaatcggccctcaggggtttctgatcgcttctctggctccaagtctggcaacacggcctccctggacatctctgggctccagcctgaggacgaggctgattattactgcatctcatattcacgaggcagcactccttatgtcatcggaactgggaccaaggtgaccgtccta

SEQ ID NO: 349 - DNA, 720 bp, Artificial Sequence
  Synthetic
  BCMA-20 scFv (nt)
gaggtgcagctgttggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaggggggcctaggaataaccccatactactttgactactggggccagggaaccctggtcaccgtctcctcaggtggaggcggttcaggcggaggtggctctggcggtggcggatcgcagcctgtgctgactcagccaccctcagcgtctgggacccccgggcagagggtcaccatctcttgttcgggaggcaagactgtaaactggttccggcaggtcccaggaacggccccccaactcctcatctatagtaatgatcagcggccctcaggggtccctgaccgattctctggctccaagtctggctcctcagcctccctggacatcagtgggctccagtctgaggatgaggcttattattactgtggatcatgggatgacagcctcaatgcttgggtgttcggcggagagaccaagctgaccgtccta

SEQ ID NO: 350 - DNA, 729 bp, Artificial Sequence
  Synthetic
  BCMA-21 scFv (nt)
gaagtgcagctggtggagtctgggggaggcttggtcaagcctggagggtccctgaaactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaaagtagacggaggctacacagaggactactggggccagggaaccctggtcaccgtctcctcaggtggaggcggttcaggcggaggtggctctggcggtggcggatcgcagtctgtgctgactcagccaccctcagcgtctgggacccccgggcagagggtcaccatctcttgttctggaagcggctccaacatcggaagtaatgatgtctcctggtatcagcagatcccaggaacggcccccaaactcctcatctactggaatgatcagcggccctcaggggtccctgaccggttctcaggctccaagtctggcatctcagcctccctggccatcagcgggctccggtccgaggatgaggctgattattactgtgcagcatgggatgacagcctgaatggttatgtcttcggaactgggaccaaggtcaccgtccta

SEQ ID NO: 351 - DNA, 729 bp, Artificial Sequence
  Synthetic
  BCMA-22 scFv (nt)
gaagtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaaagtagacggagactacacagaggactactggggccagggaaccctggtcaccgtctcctcaggtggaggcggttcaggcggaggtggctctggcggtggcggatcgcagtctgccctgactcagcctgcctccgtgtctgggtctcctggacagtcgatcactatctcctgcactggaagcagcagtgatgttggcaaatataatcttgtctcctggtaccaacagcccccaggcaaagcccccaagctcataatttatgacgtcaataagcggccctcaggggtttctaatcgcttctctggctccaagtctggcaacacggccaccctgacaatctctgggctccagggtgacgacgaggctgattattattgttgctcatatggaggtagtaggtcttatgtcttcggaactgggaccaaggtgaccgtccta

SEQ ID NO: 352 - DNA, 729 bp, Artificial Sequence
  Synthetic
  BCMA-23 scFv (nt)
gaagtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaaagtagacggagactacacagaggactactggggccagggaaccctggtcaccgtctcctcaggtggaggcggttcaggcggaggtggctctggcggtggcggatcgcagtctgccctgactcagcctgcctccgtgtctgggtctcctggacagtcgatcactatctcctgcactggaagcagcagtgatgttggcaaatataatcttgtctcctggtaccaacagcccccaggcaaagcccccaagctcataatttatgacgtcaataagcggccctcaggggtttctaatcgcttctctggctccaagtctggcaacacggccaccctgacaatctctgggctccagggtgacgacgaggctgattattattgtagctcatatggaggtagtaggtcttatgtcttcggaactgggaccaaggtgaccgtccta

SEQ ID NO: 353 - protein, 5 aa, Artificial Sequence
  Synthetic
  Consensus CDR-H1
  VARIANT 1: Xaa = d or s
  VARIANT 2: Xaa = y or s
  VARIANT 3: Xaa = a, g, w or y
  VARIANT 5: Xaa = h, q or s
XXXMX

SEQ ID NO: 354 - protein, 19 aa, Artificial Sequence
  Synthetic
  Consensus CDR-H2
  VARIANT 1: Xaa = F, G, H, V, W or Y
  VARIANT 2: Xaa = N, R, S or V
  VARIANT 3: Xaa = P, Q, S, V, W or Y
  VARIANT 4: Xaa = K or null
  VARIANT 5: Xaa = A or null
  VARIANT 6: Xaa = D, G, N, S, or Y
  VARIANT 7: Xaa = G or S
  VARIANT 8: Xaa = G or S
  VARIANT 9: Xaa = E, G, N, T or S
  VARIANT 10: Xaa = I, K, or T
  VARIANT 11: Xaa = E, G, N or Y
  VARIANT 12: Xaa = A or V
  VARIANT 13: Xaa = A, D or Q
  VARIANT 14: Xaa = K or S
  VARIANT 15: Xaa = F or V
  VARIANT 16: Xaa = K or Q
XIXXXXXXXXXXYXXXXXX

SEQ ID NO: 355 - protein, 14 aa, Artificial Sequence
  Synthetic
  Consensus CDR-H3
  VARIANT 1: Xaa = A, D, E, G, L, V or W
  VARIANT 2: Xaa = A, D, G, L, P, Q or S
  VARIANT 3: Xaa = A, D, G, L or Y
  VARIANT 4: Xaa = D, G, P, R, S, V, Y or null
  VARIANT 5: Xaa = D, I, P, S, T, Y or null
  VARIANT 6: Xaa = A, G, I, S, T, V, Y or null
  VARIANT 7: Xaa = A, D, E, F, L, P, S, Y or null
  VARIANT 8: Xaa = P, Q, T, Y or null
  VARIANT 9: Xaa = D, G, R, Y or null
  VARIANT 10: Xaa = A, F, Y or null
  VARIANT 11: Xaa = D, F or null
  VARIANT 12: Xaa = F or null
  VARIANT 13: Xaa = D, T or Y
  VARIANT 14: Xaa = I, L, N, V or Y
XXXXXXXXXXXXXX

SEQ ID NO: 356 - protein, 17 aa, Artificial Sequence
  Synthetic
  Consensus CDR-L1
  VARIANT 1: Xaa = G, K, R, S or T
  VARIANT 2: Xaa = A, G or S
  VARIANT 3: Xaa = G, N, S or T
  VARIANT 4: Xaa = G, K, N, Q, R or S
  VARIANT 5: Xaa = S or null
  VARIANT 6: Xaa = D, N, V or null
  VARIANT 7: Xaa = L, V or null
  VARIANT 8: Xaa = H, S, Y or null
  VARIANT 9: Xaa = S, T or null
  VARIANT 10: Xaa = S or null
  VARIANT 11: Xaa = D, G, I, N, S or null
  VARIANT 12: Xaa = D, E, G, K, I, N or null
  VARIANT 13: Xaa = F, G, K, N, R, S, Y or null
  VARIANT 14: Xaa = D, K, N, T or null
  VARIANT 15: Xaa = A, D, G, L, N, S, T or Y
  VARIANT 16: X16 = L or V
XXXXXXXXXXXXXXXXX

SEQ ID NO: 357 - protein, 7 aa, Artificial Sequence
  Synthetic
  Consensus CDR-L2
  VARIANT 1: Xaa = A, D, E, N, S, V or W
  VARIANT 2: Xaa = A, D, N, S or V
  VARIANT 3: Xaa = A, D, H, I, N or S
  VARIANT 4: Xaa = D, K, N, Q, R or T
  VARIANT 5: Xaa = L, R or V
  VARIANT 6: Xaa = A, E, P or Q
  VARIANT 7: Xaa = A, D, S or T
XXXXXXX

SEQ ID NO: 358 - protein, 12 aa, Artificial Sequence
  Synthetic
  Consensus CDR-L3
  VARIANT 1: Xaa = A, C, G, H, I, Q or S
  VARIANT 2: Xaa = A, Q, S or V
  VARIANT 3: Xaa = S, W or Y
  VARIANT 4: Xaa = D, F, G, H or Y
  VARIANT 5: Xaa = D, G, M, R, S or T
  VARIANT 6: Xaa = A, G, H, L, R, S, T or Y
  VARIANT 7: Xaa = L, P, R, S or null
  VARIANT 8: Xaa = D, G, N, R, S, T or null
  VARIANT 9: Xaa = A, G, H, L, P or null
  VARIANT 10: Xaa = F, S or null
  VARIANT 11: Xaa = L, P, W or Y
  VARIANT 12: Xaa = S, T or V
XXXXXXXXXXXX

SEQ ID NO: 359 - protein, 5 aa, Artificial Sequence
  Synthetic
  4GS linker (aa)
GGGGS

SEQ ID NO: 360 - protein, 4 aa, Artificial Sequence
  Synthetic
  3GS linker (aa)
GGGS

SEQ ID NO: 361 - protein, 15 aa, Artificial Sequence
  Synthetic
  (4GS)3 linker (aa)
GGGGSGGGGSGGGGS

SEQ ID NO: 362 - protein, 18 aa, Artificial Sequence
  Synthetic
  Linker (aa)
GSTSGSGKPGSGEGSTKG

SEQ ID NO: 363 - protein, 12 aa, Artificial Sequence
  Synthetic
  Spacer (IgG4hinge) (aa)
ESKYGPPCPPCP

SEQ ID NO: 364 - DNA, 36 bp, Artificial Sequence
  Synthetic
  Spacer (IgG4hinge) (nt)
gaatctaagtacggaccgccctgccccccttgccct

SEQ ID NO: 365 - protein, 119 aa, Artificial Sequence
  Synthetic
  Hinge-CH3 spacer (aa)
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 366 - protein, 229 aa, Artificial Sequence
  Synthetic
  Hinge-CH2-CH3 spacer (aa)
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 367 - protein, 184 aa, Homo sapiens [sequence omitted]

SEQ ID NO: 368 - protein, 184 aa, Homo sapiens
  Human BCMA; NCBI No. NP_001183.2
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 369 - protein, 135 aa, Homo sapiens
  Human BCMA Variant; GenBank No. ABN42510.1
MLQMAGQCSQNEYFDSLLHACIPCQLRCSSNTPPLTCQRYCNARSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 370 - protein, 185 aa, Mus musculus
  Mouse BCMA; NCBI No. NP_035738.1
MAQQCFHSEYFDSLLHACKPCHLRCSNPPATCQPYCDPSVTSSVKGTYTVLWIFLGLTLVLSLALFTISFLLRKMNPEALKDEPQSPGQLDGSAQLDKADTELTRIRAGDDRIFPRSLEYTVEECTCEDCVKSKPKGDSDHFFPLPAMEEGATILVTTKTGDYGKSSVPTALQSVMGMEKPTHTR

SEQ ID NO: 371 - protein, 183 aa, Macaca fascicular
  Cynomolgus BCMA; GenBank No. EHH60172.1
MLQMARQCSQNEYFDSLLHDCKPCQLRCSSTPPLTCQRYCNASMTNSVKGMNAILWTCLGLSLIISLAVFVLTFLLRKMSSEPLKDEFKNTGSGLLGMANIDLEKGRTGDEIVLPRGLEYTVEECTCEDCIKNKPKVDSDHCFPLPAMEEGATILVTTKTNDYCNSLSAALSVTEIEKSISAR

SEQ ID NO: 372 - protein, 17 aa, Artificial Sequence
  Synthetic
  BCMA-28 CDR-H2 (aa) Kabat numbering
  VARIANT 10: Xaa = any amino acid
GISWNSGSIXYADSVKG

SEQ ID NO: 373 - protein, 17 aa, Artificial Sequence
  Synthetic
  BCMA-33 CDR-H2 (aa) Kabat numbering
YISGSGSTIYYADSVKG

SEQ ID NO: 374 - protein, 17 aa, Artificial Sequence
  Synthetic
  BCMA-41 CDR-H2 Kabat numbering
YISSSGNTIYYADSVKG

SEQ ID NO: 375 - protein, 7 aa, Homo sapiens
  human BCMA epitope (residues 21-27)
CIPCQLR

SEQ ID NO: 376 - protein, 13 aa, Artificial Sequence
  Synthetic
  BCMA-24, -28, -29, -39 CDR-H3 (aa)
DLGPPYGDDAFDI

SEQ ID NO: 377 - protein, 10 aa, Artificial Sequence
  Synthetic
  BCMA-30 CDR-H3 (aa)
DLDPDDAFDI

SEQ ID NO: 378 - protein, 8 aa, Artificial Sequence
  Synthetic
  BCMA-35 CDR-H3 (aa)
VDGDYDDY

SEQ ID NO: 379 - protein, 10 aa, Homo sapiens
  human BCMA epitope (residues 30-39)
SNTPPLTCQR

SEQ ID NO: 380 - protein, 11 aa, Artificial Sequence
  Synthetic
  BCMA-25 CDR-L1 (aa)
RASQGISNYLA

SEQ ID NO: 381 - protein, 16 aa, Artificial Sequence
  Synthetic
  BCMA-28 CDR-L1 (aa)
RSSQSLLHSNGYNYLD

SEQ ID NO: 382 - protein, 14 aa, Artificial Sequence
  Synthetic
  BCMA-29 CDR-L1 (aa)
TGTSSDVGSYNLVS

SEQ ID NO: 383 - protein, 11 aa, Artificial Sequence
  Synthetic
  BCMA-30 CDR-L1 (aa)
RASQPIRSNLA

SEQ ID NO: 384 - protein, 17 aa, Artificial Sequence
  Synthetic
  BCMA-31 CDR-L1 (aa)
KSSQSVLNSSNNKNYVA

SEQ ID NO: 385 - protein, 11 aa, Artificial Sequence
  Synthetic
  BCMA-32 CDR-L1 (aa)
GGNNIGSKGVH

SEQ ID NO: 386 - protein, 11 aa, Artificial Sequence
  Synthetic
  BCMA-34 CDR-L1 (aa)
RASQSISNYLA

SEQ ID NO: 387 - protein, 14 aa, Artificial Sequence
  Synthetic
  BCMA-36 CDR-L1 (aa)
GSSTGPVTSAHSPS

SEQ ID NO: 388 - protein, 14 aa, Artificial Sequence
  Synthetic
  BCMA-37, -38 CDR-L1 (aa)
GSSTGAVTNGHSPY

SEQ ID NO: 389 - protein, 11 aa, Artificial Sequence
  Synthetic
  BCMA-39 CDR-L1 (aa)
  VARIANT 11: Xaa = any amino acid
RASQGIRYELX

SEQ ID NO: 390 - protein, 14 aa, Artificial Sequence
  Synthetic
  BCMA-40 CDR-L1 (aa)
TGSSSDVSKYNLVS

SEQ ID NO: 391 - protein, 13 aa, Artificial Sequence
  Synthetic
  BCMA-41 CDR-L1 (aa)
SGSSSNIGGNSVD

SEQ ID NO: 392 - protein, 11 aa, Artificial Sequence
  Synthetic
  BCMA-42 CDR-L1 (aa)
RASQGIGNGLA

SEQ ID NO: 393 - protein, 7 aa, Homo sapiens
  human BCMA epitope (residues 44-50)
SVTNSVK

SEQ ID NO: 394 - protein, 17 aa, Artificial Sequence
  Synthetic
  BCMA-44 CDR-L1 (aa)
KSSQNLLYSSNNKNYLA

SEQ ID NO: 395 - protein, 11 aa, Artificial Sequence
  Synthetic
  BCMA-45 CDR-L1 (aa)
RASQGIGRSLA

SEQ ID NO: 396 - protein, 11 aa, Artificial Sequence
  Synthetic
  BCMA-47, -48 CDR-L1 (aa)
GGNNIGSKSVH

SEQ ID NO: 397 - protein, 11 aa, Artificial Sequence
  Synthetic
  BCMA-49 CDR-L1 (aa)
GGDQIGRKSVH

SEQ ID NO: 398 - protein, 11 aa, Artificial Sequence
  Synthetic
  BCMA-51 CDR-L1 (aa)
RASQNIGDWLA

SEQ ID NO: 399 - protein, 7 aa, Artificial Sequence
  Synthetic
  BCMA-24 CDR-L2 (aa)
WGSTRES

SEQ ID NO: 400 - protein, 7 aa, Artificial Sequence
  Synthetic
  BCMA-25 CDR-L2 (aa)
SASTLQS

SEQ ID NO: 401 - protein, 7 aa, Artificial Sequence
  Synthetic
  BCMA-28 CDR-L2 (aa)
LGSNRAS

SEQ ID NO: 402 - protein, 7 aa, Artificial Sequence
  Synthetic
  BCMA-29 CDR-L2 (aa)
EVSKRPS

SEQ ID NO: 403 - protein, 7 aa, Artificial Sequence
  Synthetic
  BCMA-30 CDR-L2 (aa)
SASTRAT

SEQ ID NO: 404 - protein, 7 aa, Artificial Sequence
  Synthetic
  BCMA-34 CDR-L2 (aa)
DASNRAT

SEQ ID NO: 405 - protein, 7 aa, Artificial Sequence
  Synthetic
  BCMA-36 CDR-L2 (aa)
ETTNRHS

SEQ ID NO: 406 - protein, 7 aa, Artificial Sequence
  Synthetic
  BCMA-37 CDR-L2 (aa)
DTTNRHS

SEQ ID NO: 407 - protein, 7 aa, Artificial Sequence
  Synthetic
  BCMA-38 CDR-L2 (aa)
DTNNRHS

SEQ ID NO: 408 - protein, 7 aa, Artificial Sequence
  Synthetic
  BCMA-39 CDR-L2 (aa)
AASTLQS

SEQ ID NO: 409 - protein, 7 aa, Artificial Sequence
  Synthetic
  BCMA-41 CDR-L2 (aa)
ANDRRPS

SEQ ID NO: 410 - protein, 7 aa, Homo sapiens
  human BCMA epitope (residues 8-15)
CSQNEYF

SEQ ID NO: 411 - protein, 7 aa, Artificial Sequence
  Synthetic
  BCMA-45 CDR-L2 (aa)
DASSLRS

SEQ ID NO: 412 - protein, 7 aa, Artificial Sequence
  Synthetic
  BCMA-47, -48 CDR-L2 (aa)
YDTDRPS

SEQ ID NO: 413 - protein, 7 aa, Artificial Sequence
  Synthetic
  BCMA-49 CDR-L2 (aa)
YDSDRPS

SEQ ID NO: 414 - protein, 7 aa, Artificial Sequence
  Synthetic
  BCMA-51 CDR-L2 (aa)
GASILES

SEQ ID NO: 415 - protein, 9 aa, Artificial Sequence
  Synthetic
  BCMA-24 CDR-L3 (aa)
QQYISLPWT

SEQ ID NO: 416 - protein, 9 aa, Artificial Sequence
  Synthetic
  BCMA-25 CDR-L3 (aa)
QQSYTSRQT

SEQ ID NO: 417 - protein, 10 aa, Artificial Sequence
  Synthetic
  BCMA-28 CDR-L3 (aa)
MQALQTPPWT

SEQ ID NO: 418 - protein, 12 aa, Artificial Sequence
  Synthetic
  BCMA-29 CDR-L3 (aa)
CSYAGSSTSRDV

SEQ ID NO: 419 - protein, 7 aa, Artificial Sequence
  Synthetic
  BCMA-30 CDR-L3 (aa)
RHYAPLT

SEQ ID NO: 420 - protein, 10 aa, Artificial Sequence
  Synthetic
  BCMA-34 CDR-L3 (aa)
QQRSNWPPYT

SEQ ID NO: 421 - protein, 11 aa, Artificial Sequence
  Synthetic
  BCMA-26, -35 CDR-L3 (aa)
HLWDRSRDHYV

SEQ ID NO: 422 - protein, 10 aa, Artificial Sequence
  Synthetic
  BCMA-36 CDR-L3 (aa)
LLSSGDARMV

SEQ ID NO: 423 - protein, 10 aa, Artificial Sequence
  Synthetic
  BCMA-37 CDR-L3 (aa)
SLSHAGDRVF

SEQ ID NO: 424 - protein, 10 aa, Artificial Sequence
  Synthetic
  BCMA-38 CDR-L3 (aa)
LLSYSDARLA

SEQ ID NO: 425 - protein, 9 aa, Artificial Sequence
  Synthetic
  BCMA-39 CDR-L3 (aa)
LQHNSYPLT

SEQ ID NO: 426 - protein, 11 aa, Artificial Sequence
  Synthetic
  BCMA-41 CDR-L3 (aa)
ESWDDALNGHV

SEQ ID NO: 427 - protein, 9 aa, Artificial Sequence
  Synthetic
  BCMA-42 CDR-L3 (aa)
QQYVEDALT

SEQ ID NO: 428 - protein, 11 aa, Homo sapiens
  human BCMA epitope (residues 17-27)
LLHACIPCQLR

SEQ ID NO: 429 - protein, 9 aa, Artificial Sequence
  Synthetic
  BCMA-44 CDR-L3 (aa)
QQYYSSPYT

SEQ ID NO: 430 - protein, 9 aa, Artificial Sequence
  Synthetic
  BCMA-45 CDR-L3 (aa)
QQLNGYPWT

SEQ ID NO: 431 - protein, 11 aa, Artificial Sequence
  Synthetic
  BCMA-47 CDR-L3 (aa)
QLWDSDSDDFA

SEQ ID NO: 432 - protein, 12 aa, Artificial Sequence
  Synthetic
  BCMA-49 CDR-L3 (aa)
QVWDSSTGQYVV

SEQ ID NO: 433 - protein, 10 aa, Artificial Sequence
  Synthetic
  BCMA-51 CDR-L3 (aa)
QKYDGAPPWT

SEQ ID NO: 434 - protein, 30 aa, Artificial Sequence
  Synthetic
  BCMA-27 VH FR1 (aa)
EVQLLESGGGLVQPGRSLRLSCVASGFTFD

SEQ ID NO: 435 - protein, 30 aa, Artificial Sequence
  Synthetic
  BCMA-30 VH FR1 (aa)
QVQLVQSGGGLVQPGRSLRLSCAASGFTFG

SEQ ID NO: 436 - protein, 30 aa, Artificial Sequence
  Synthetic
  BCMA-25, -31, -44, -51 VH FR1 (aa)
EVQLVQSGGGLVQPGRSLRLSCTASGFTFG

SEQ ID NO: 437 - protein, 30 aa, Artificial Sequence
  Synthetic
  BCMA-32, -49 VH FR1 (aa)
QVQLVESGGGLVKPGGSLRLSCAASGFTFS

SEQ ID NO: 438 - protein, 30 aa, Artificial Sequence
  Synthetic
  BCMA-34 VH FR1 (aa)
TGQLVQSGGGLVQPGRSLRLSCAASGFTFD

SEQ ID NO: 439 - protein, 30 aa, Artificial Sequence
  Synthetic
  BCMA-42 VH FR1 (aa)
EVQLLESGGGLVQPGRSLRLSCTASGFTFG

SEQ ID NO: 440 - DNA, 744 bp, Artificial Sequence
  Synthetic
  BCMA-52 scFv (nt) (O/SSE)
agctatgagctgacacagcctccaagcgcctctggcacacctggacagcgagtgacaatgagctgtagcggcaccagcagcaacatcggcagccacagcgtgaactggtatcagcagctgcctggcacagcccctaaactgctgatctacaccaacaaccagcggcctagcggcgtgcccgatagattttctggcagcaagagcggcacaagcgccagcctggctatttctggactgcagagcgaggacgaggccgactattattgtgccgcctgggacggctctctgaacggccttgtttttggcggaggcaccaagctgacagtgctgggatctagaggtggcggaggatctggcggcggaggaagcggaggcggcggatctcttgaaatggctgaagtgcagctggtgcagtctggcgccgaagtgaagaagcctggcgagagcctgaagatcagctgcaaaggcagcggctacagcttcaccagctactggatcggctgggtccgacagatgcctggcaaaggccttgagtggatgggcatcatctaccccggcgacagcgacaccagatacagccctagctttcagggccacgtgaccatcagcgccgacaagtctatcagcaccgcctacctgcagtggtccagcctgaaggcctctgacaccgccatgtactactgcgccagatactctggcagcttcgacaattggggccagggcacactggtcaccgtgtccagc

SEQ ID NO: 441 - protein, 32 aa, Artificial Sequence
  Synthetic
  BCMA-37 VH FR3 (aa)
RFTISRDNAKSSLYLQMNSLRAEDTAVYYCAR

SEQ ID NO: 442 - protein, 248 aa, Artificial Sequence
  Synthetic
  BCMA-52 scFv (aa)
SYELTQPPSASGTPGQRVTMSCSGTSSNIGSHSVNWYQQLPGTAPKLLIYTNNQRPSGVPDRFSGSKSGTSASLAISGLQSEDEADYYCAAWDGSLNGLVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGHVTISADKSISTAYLQWSSLKASDTAMYYCARYSGSFDNWGQGTLVTVSS

SEQ ID NO: 443 - protein, 32 aa, Artificial Sequence
  Synthetic
  BCMA-47 VH FR3 (aa)
DSPSPGTTPKNSLYLQMNSLRAEDTAVYYCAK

SEQ ID NO: 444 - protein, 11 aa, Artificial Sequence
  Synthetic
  BCMA-28 VH FR4 (aa)
GGQGTMVTVSS

SEQ ID NO: 445 - protein, 11 aa, Artificial Sequence
  Synthetic
  BCMA-47 VH FR4 (aa)
WRQGTMVTVSS

SEQ ID NO: 446 - protein, 23 aa, Artificial Sequence
  Synthetic
  BCMA-25 VL FR1 (aa)
DIQMTQSPAFLSASVGDRVTVTC

SEQ ID NO: 447 - protein, 23 aa, Artificial Sequence
  Synthetic
  BCMA-28 VL FR1 (aa)
DIVMTQSPLSLSVTPGEPASISC

SEQ ID NO: 448 - protein, 22 aa, Artificial Sequence
  Synthetic
  BCMA-29 VL FR1 (aa)
QPVLTQPASVSGSPGQSITISC

SEQ ID NO: 449 - protein, 23 aa, Artificial Sequence
  Synthetic
  BCMA-30 VL FR1 (aa)
EIVLTQSPATLSVSPGERATLSC

SEQ ID NO: 450 - protein, 23 aa, Artificial Sequence
  Synthetic
  BCMA-31 VL FR1 (aa)
DVVMTQSPDSLAVSLGERATISC

SEQ ID NO: 451 - protein, 22 aa, Artificial Sequence
  Synthetic
  BCMA-32 VL FR1 (aa)
QTVVTQPPSVSVAPGQTARITC

SEQ ID NO: 452 - protein, 23 aa, Artificial Sequence
  Synthetic
  BCMA-34 VL FR1 (aa)
EIVMTQSPATLSLSPGDRATLSC

SEQ ID NO: 453 - protein, 22 aa, Artificial Sequence
  Synthetic
  BCMA-35 VL FR1 (aa)
NFMLTQPPSVSVAPGQTARITC

SEQ ID NO: 454 - protein, 22 aa, Artificial Sequence
  Synthetic
  BCMA-36 VL FR1 (aa)
QSVLTQEPSLTVSPGETVTLTC

SEQ ID NO: 455 - protein, 22 aa, Artificial Sequence
  Synthetic
  BCMA-37 VL FR1 (aa)
QLVLTQEPSLTVSPGGTVTLTC

SEQ ID NO: 456 - protein, 22 aa, Artificial Sequence
  Synthetic
  BCMA-38 VL FR1 (aa)
QAVLTQEPSLTVSPGGTVTLTC

SEQ ID NO: 457 - protein, 23 aa, Artificial Sequence
  Synthetic
  BCMA-39 VL FR1 (aa)
  VARIANT 4: Xaa = any amino acid
DIQXTQSPSSLSASVGDRVTITC

SEQ ID NO: 458 - protein, 22 aa, Artificial Sequence
  Synthetic
  BCMA-41 VL FR1 (aa)
QPVLTQPPSVSGTPGQRVTIPC

SEQ ID NO: 459 - protein, 23 aa, Artificial Sequence
  Synthetic
  BCMA-42 VL FR1 (aa)
DIQMTQSPSLVSASVGDRVTITC

SEQ ID NO: 460 - DNA, 732 bp, Artificial Sequence
  Synthetic
  BCMA-55 scFv (nt) (O/SSE)
cagtctgccctgacacagcctgccagcgttagtgctagtcccggacagtctatcgccatcagctgtaccggcaccagctctgacgttggctggtatcagcagcaccctggcaaggcccctaagctgatgatctacgaggacagcaagaggcccagcggcgtgtccaatagattcagcggcagcaagagcggcaacaccgccagcctgacaattagcggactgcaggccgaggacgaggccgattactactgcagcagcaacacccggtccagcacactggtttttggcggaggcaccaagctgacagtgctgggatctagaggtggcggaggatctggcggcggaggaagcggaggcggcggatctcttgaaatggctgaagtgcagctggtgcagtctggcgccgagatgaagaaacctggcgcctctctgaagctgagctgcaaggccagcggctacaccttcatcgactactacgtgtactggatgcggcaggcccctggacagggactcgaatctatgggctggatcaaccccaatagcggcggcaccaattacgcccagaaattccagggcagagtgaccatgaccagagacaccagcatcagcaccgcctacatggaactgagccggctgagatccgacgacaccgccatgtactactgcgccagatctcagcgcgacggctacatggattattggggccagggaaccctggtcaccgtgtccagc

SEQ ID NO: 461 - protein, 23 aa, Artificial Sequence
  Synthetic
  BCMA-44 VL FR1 (aa)
DVVMTQSPDSLAVSLGERATINC

SEQ ID NO: 462 - protein, 23 aa, Artificial Sequence
  Synthetic
  BCMA-45 VL FR1 (aa)
AIRMTQSPSSLSASVGDRVTITC

SEQ ID NO: 463 - protein, 22 aa, Artificial Sequence
  Synthetic
  BCMA-47 VL FR1 (aa)
QAVLTQPPSVSVAPGKTATITC

SEQ ID NO: 464 - protein, 22 aa, Artificial Sequence
  Synthetic
  BCMA-48 VL FR1 (aa)
QPVLTQPPSVSVAPGKTATITC

SEQ ID NO: 465 - protein, 22 aa, Artificial Sequence
  Synthetic
  BCMA-49 VL FR1 (aa)
LPVLTQPPSVSVAPGKTARITC

SEQ ID NO: 466 - protein, 23 aa, Artificial Sequence
  Synthetic
  BCMA-51 VL FR1 (aa)
AIQLTQSPSTLSASVGDRVAITC

SEQ ID NO: 467 - protein, 15 aa, Artificial Sequence
  Synthetic
  BCMA-25 VL FR2 (aa)
WYQQKPGNAPRLLIY

SEQ ID NO: 468 - protein, 15 aa, Artificial Sequence
  Synthetic
  BCMA-28 VL FR2 (aa)
WYLQKPGQSPQLLIY

SEQ ID NO: 469 - protein, 15 aa, Artificial Sequence
  Synthetic
  BCMA-29 VL FR2 (aa)
WYQQHPGKAPKLMIY

SEQ ID NO: 470 - protein, 15 aa, Artificial Sequence
  Synthetic
  BCMA-30 VL FR2 (aa)
WYQQKPGQAPKLLIY

SEQ ID NO: 471 - protein, 15 aa, Artificial Sequence
  Synthetic
  BCMA-31 VL FR2 (aa)
WYKQKPGQPPKLVIS

SEQ ID NO: 472 - protein, 15 aa, Artificial Sequence
  Synthetic
  BCMA-32 VL FR2 (aa)
WYRQRPGQAPEVVIY

SEQ ID NO: 473 - protein, 15 aa, Artificial Sequence
  Synthetic
  BCMA-36 VL FR2 (aa)
WFQKKPGQAPTTLIY

SEQ ID NO: 474 - protein, 15 aa, Artificial Sequence
  Synthetic
  BCMA-37, -38 VL FR2 (aa)
WFQQKPGQAPRTLIY

SEQ ID NO: 475 - protein, 15 aa, Artificial Sequence
  Synthetic
  BCMA-39 VL FR2 (aa)
WYQQKPGKAPKLLIY

SEQ ID NO: 476 - protein, 15 aa, Artificial Sequence
  Synthetic
  BCMA-41 VL FR2 (aa)
WFQEVPGTAPKLLIY

SEQ ID NO: 477 - protein, 15 aa, Artificial Sequence
  Synthetic
  BCMA-42 VL FR2 (aa)
WYQQKPGKAPKLLLF

SEQ ID NO: 478 - protein, 244 aa, Artificial Sequence
  Synthetic
  BCMA-55 scFv (aa)
QSALTQPASVSASPGQSIAISCTGTSSDVGWYQQHPGKAPKLMIYEDSKRPSGVSNRFSGSKSGNTASLTISGLQAEDEADYYCSSNTRSSTLVFGGGTKLTVLGSRGGGGSGGGGSGGGGSLEMAEVQLVQSGAEMKKPGASLKLSCKASGYTFIDYYVYWMRQAPGQGLESMGWINPNSGGTNYAQKFQGRVTMTRDTSISTAYMELSRLRSDDTAMYYCARSQRDGYMDYWGQGTLVTVSS

SEQ ID NO: 479 - protein, 15 aa, Artificial Sequence
  Synthetic
  BCMA-45 VL FR2 (aa)
WYKQKPGGVPQLLIH

SEQ ID NO: 480 - protein, 15 aa, Artificial Sequence
  Synthetic
  BCMA-47, -48 VL FR2 (aa)
WYQRKPGQGPVVVIQ

SEQ ID NO: 481 - protein, 15 aa, Artificial Sequence
  Synthetic
  BCMA-49 VL FR2 (aa)
WYQQKPGQAPVLVMS

SEQ ID NO: 482 - protein, 15 aa, Artificial Sequence
  Synthetic
  BCMA-51 VL FR2 (aa)
WYQQKPGKAPKLLIF

SEQ ID NO: 483 - protein, 32 aa, Artificial Sequence
  Synthetic
  BCMA-24 VL FR3 (aa)
GVPDRFSGSGSGTDFTLTISSLQAEDVAIYHC

SEQ ID NO: 484 - protein, 32 aa, Artificial Sequence
  Synthetic
  BCMA-25 VL FR3 (aa)
GVPSRFRGTGYGTEFSLTIDSLQPEDFATYYC

SEQ ID NO: 485 - protein, 32 aa, Artificial Sequence
  Synthetic
  BCMA-28 VL FR3 (aa)
GVPDRFSGSGSGTDFTLKISRVEAEDVGVYYC

SEQ ID NO: 486 - protein, 32 aa, Artificial Sequence
  Synthetic
  BCMA-29 VL FR3 (aa)
GVSNRFSGSKSGNTASPTISGLQAEDEADYYC

SEQ ID NO: 487 - protein, 32 aa, Artificial Sequence
  Synthetic
  BCMA-30 VL FR3 (aa)
GIPDRFSGSGSGTDFTLTISRLEHEDFAVYYR

SEQ ID NO: 488 - protein, 32 aa, Artificial Sequence
  Synthetic
  BCMA-32 VL FR3 (aa)
GVPDRFSGSNSGNTATLTVRGVEAGDEADYYC

SEQ ID NO: 489 - protein, 32 aa, Artificial Sequence
  Synthetic
  BCMA-34 VL FR3 (aa)
GIPARFSGSGSGTDFTLTISSLEPEDFAVYYC

SEQ ID NO: 490 - protein, 32 aa, Artificial Sequence
  Synthetic
  BCMA-36 VL FR3 (aa)
WTPARFSGSLLGGKAALTLSGAQPEDEADYYC

SEQ ID NO: 491 - protein, 32 aa, Artificial Sequence
  Synthetic
  BCMA-37 VL FR3 (aa)
WTPARFSGSLLGGKAALTLSGAQPEDEAEYYC

SEQ ID NO: 492 - protein, 32 aa, Artificial Sequence
  Synthetic
  BCMA-38 VL FR3 (aa)
WTPARFSGSLLGGKAALTLSGAQPEDEADYFC

SEQ ID NO: 493 - protein, 32 aa, Artificial Sequence
  Synthetic
  BCMA-39 VL FR3 (aa)
GVPSRFSGSGSGTDFALTIRSLQPEDFATYYC

SEQ ID NO: 494 - protein, 32 aa, Artificial Sequence
  Synthetic
  BCMA-41 VL FR3 (aa)
GVPDRFSGTKSGTSASLAIRGLQSDDDAHYYC

SEQ ID NO: 495 - protein, 32 aa, Artificial Sequence
  Synthetic
  BCMA-42 VL FR3 (aa)
GVPSRFSGSRSGTDYTLTISSLQPEDVATYYC

SEQ ID NO: 496 - DNA, 350 bp, Artificial Sequence
  Synthetic
  BCMA-52 VH chain (nt)
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccacgtcaccatctcagctgacaagtccatcagcactgcctacctgcagtggagcagcctgaaggcctcggacaccgccatgtattactgtgcgcgctactctggttctttcgataactggggtcaaggtactctggtgaccgtctcctcagc

SEQ ID NO: 497 - protein, 32 aa, Artificial Sequence
  Synthetic
  BCMA-45 VL FR3 (aa)
GVPSRFSGSGSGTEFTLTISGVQSEDSATYHC

SEQ ID NO: 498 - protein, 32 aa, Artificial Sequence
  Synthetic
  BCMA-47 VL FR3 (aa)
GIPERFSGSKSGDTASLTISGVEAGDEADYYC

SEQ ID NO: 499 - protein, 32 aa, Artificial Sequence
  Synthetic
  BCMA-48 VL FR3 (aa)
GIPERFSGSNSGNTATLTISRVEAGDEGDYYC

SEQ ID NO: 500 - protein, 32 aa, Artificial Sequence
  Synthetic
  BCMA-49 VL FR3 (aa)
GIPERFSGSNSGNTATLTISRVEAGDEAAYYC

SEQ ID NO: 501 - protein, 32 aa, Artificial Sequence
  Synthetic
  BCMA-51 VL FR3 (aa)
GVPSRFSGSGSGTDFTLTISSLQPEDVAVYYC

SEQ ID NO: 502 - protein, 10 aa, Artificial Sequence
  Synthetic
  BCMA-25 VL FR4 (aa)
FGPGTRLDIK

SEQ ID NO: 503 - protein, 10 aa, Artificial Sequence
  Synthetic
  BCMA-29 VL FR4 (aa)
  VARIANT 3: Xaa = any amino acid
FGXGTKLTVL

SEQ ID NO: 504 - protein, 10 aa, Artificial Sequence
  Synthetic
  BCMA-31, -34 VL FR4 (aa)
FGQGTKLDIK

SEQ ID NO: 505 - protein, 10 aa, Artificial Sequence
  Synthetic
  BCMA-35 VL FR4 (aa)
FGTGTKLDIK

SEQ ID NO: 506 - protein, 10 aa, Artificial Sequence
  Synthetic
  BCMA-42 VL FR4 (aa)
FGGGTKVDIK

SEQ ID NO: 507 - protein, 5 aa, Artificial Sequence
  Synthetic
  BCMA-52 CDR-H1 (aa) - Kabat numbering
SYWIG

SEQ ID NO: 508 - protein, 10 aa, Artificial Sequence
  Synthetic
  BCMA-24, -28, -51 VL FR4 (aa)
FGQGTKVEIK

SEQ ID NO: 509 - protein, 10 aa, Artificial Sequence
  Synthetic
  BCMA-30 CDR-H1 (aa) AbM numbering
GFTFGDYAMH

SEQ ID NO: 510 - protein, 10 aa, Artificial Sequence
  Synthetic
  BCMA-28 CDR-H2 (aa) AbM numbering
  VARIANT 10: Xaa = any amino acid
GISWNSGSIX

SEQ ID NO: 511 - protein, 10 aa, Artificial Sequence
  Synthetic
  BCMA-33 CDR-H2 (aa) AbM numbering
YISGSGSTIY

SEQ ID NO: 512 - protein, 10 aa, Artificial Sequence
  Synthetic
  BCMA-41 CDR-H2 AbM numbering
YISSSGNTIY

SEQ ID NO: 513 - protein, 17 aa, Artificial Sequence
  Synthetic
  BCMA-52 CDR-H2 (aa) - Kabat numbering
IIYPGDSDTRYSPSFQG

SEQ ID NO: 514 - protein, 5 aa, Artificial Sequence
  Synthetic
  BCMA-28 CDR-H2 (aa) Chothia numbering
SWNSG

SEQ ID NO: 515 - protein, 6 aa, Artificial Sequence
  Synthetic
  BCMA-33 CDR-H2 (aa) Chothia numbering
SGSGST

SEQ ID NO: 516 - protein, 6 aa, Artificial Sequence
  Synthetic
  BCMA-41 CDR-H2 Chothia numbering
SSSGNT

SEQ ID NO: 517 - protein, 7 aa, Artificial Sequence
  Synthetic
  BCMA-52 CDR-H3 (aa) - Kabat, Chothia, and AbM numbering
YSGSFDN

SEQ ID NO: 518 - protein, 122 aa, Artificial Sequence
  Synthetic
  BCMA-24 VH chain (aa)
EVQLVQSGGGLVKPGGSLRLSCAASGFTFSDYYMSWIRQAPGKGLEWVSGISWNSGSIGYADSVKGRFTISRDNAKNSLYLQMNSLRAEDTAVYYCARDLGPPYGDDAFDIWGQGTMVTVSS

SEQ ID NO: 519 - protein, 118 aa, Artificial Sequence
  Synthetic
  BCMA-25, -31, -44, -51 VH chain (aa)
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSS

SEQ ID NO: 520 - protein, 121 aa, Artificial Sequence
  Synthetic
  BCMA-27 VH chain (aa)
EVQLLESGGGLVQPGRSLRLSCVASGFTFDDYAMHWVRQAPGKGLEWVSGISWNSGSIGYADSVKGRFTISRDNAKNSLYLQMNSLRAEDTALYYCAKGGLGITPYYFDYWGQGTLVTVSS

SEQ ID NO: 521 - protein, 122 aa, Artificial Sequence
  Synthetic
  BCMA-28 VH chain (aa)
  VARIANT 59: Xaa = any amino acid
QVQLVQSGGGLVQPGRSLRLSCAASGFTFDDYAMHWVRQAPGKGLEWVSGISWNSGSIXYADSVKGRFTISRDNAKNSLYLQMNSLRAEDTAVYYCARDLGPPYGDDAFDIGGQGTMVTVSS

SEQ ID NO: 522 - protein, 122 aa, Artificial Sequence
  Synthetic
  BCMA-29, -39 VH chain (aa)
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDLGPPYGDDAFDIWGQGTMVTVSS

SEQ ID NO: 523 - protein, 119 aa, Artificial Sequence
  Synthetic
  BCMA-30 VH chain (aa)
QVQLVQSGGGLVQPGRSLRLSCAASGFTFGDYAMHWVRQAPGKGLEWVSGISWNSGSIGYADSVKGRFTISRDNAKNSLYLQMNSLRAEDTAVYYCARDLDPDDAFDIWGQGTMVTVSS

SEQ ID NO: 524 - protein, 118 aa, Artificial Sequence
  Synthetic
  BCMA-32, -49 VH chain (aa)
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSS

SEQ ID NO: 525 - protein, 117 aa, Artificial Sequence
  Synthetic
  BCMA-33 VH chain (aa)
QVQLVQSGGGLVKPGGSLRLSCAASGFTFSDYYMSWIRQAPGKGLEWVSYISGSGSTIYYADSVKGRFTISRDNAKNSLYLQMNSLRAEDTAVYYCAREADSSADYWGQGTLVNVSS

SEQ ID NO: 526 - protein, 122 aa, Artificial Sequence
  Synthetic
  BCMA-34 VH chain (aa)
TGQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDLGPDYDPDAFDIWGQGTMVTVSS

SEQ ID NO: 527 - protein, 117 aa, Artificial Sequence
  Synthetic
  BCMA-35 VH chain (aa)
EVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYDDYWGQGTLVTVSS

SEQ ID NO: 528 - protein, 118 aa, Artificial Sequence
  Synthetic
  BCMA-36, 38 VH chain (aa)
QVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYVDDYWGQGTLVTVSS

SEQ ID NO: 529 - protein, 118 aa, Artificial Sequence
  Synthetic
  BCMA-37 VH chain (aa)
EVQLVQSGGGLVKPGGSLRLSCAASGFTFSDYYMSWIRQAPGKGLEWVSYISSSGSTIYYADSVKGRFTISRDNAKSSLYLQMNSLRAEDTAVYYCARVDGDYVDDYWGQGTLVTVSS

SEQ ID NO: 530 - protein, 118 aa, Artificial Sequence
  Synthetic
  BCMA-41 VH chain (aa)
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCAKVDGDYVDDYWGQGTLVTVSS

SEQ ID NO: 531 - protein, 118 aa, Artificial Sequence
  Synthetic
  BCMA-42 VH chain (aa)
EVQLLESGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSS

SEQ ID NO: 532 - protein, 7 aa, Artificial Sequence
  Synthetic
  BCMA-52 CDR-H1 (aa) - Chothia numbering
GYSFTSY

SEQ ID NO: 533 - protein, 118 aa, Artificial Sequence
  Synthetic
  BCMA-47 VH chain (aa)
QVQLLESGGGLVKPGGSLRLSCAASGFTFSDYYMSWIRQAPGKGLEWVSYISSSGSTIYYADSVKGDSPSPGTTPKNSLYLQMNSLRAEDTAVYYCAKVDGPPSFDIWRQGTMVTVSS

SEQ ID NO: 534 - protein, 113 aa, Artificial Sequence
  Synthetic
  BCMA-24 VL chain (aa)
DIVMTQSPDSLAVSLGERATINCKSSQSVLYSSNNKNYLAWYQQKPGQPPKLLIYWGSTRESGVPDRFSGSGSGTDFTLTISSLQAEDVAIYHCQQYISLPWTFGQGTKVEIK

SEQ ID NO: 535 - protein, 107 aa, Artificial Sequence
  Synthetic
  BCMA-25 VL chain (aa)
DIQMTQSPAFLSASVGDRVTVTCRASQGISNYLAWYQQKPGNAPRLLIYSASTLQSGVPSRFRGTGYGTEFSLTIDSLQPEDFATYYCQQSYTSRQTFGPGTRLDIK

SEQ ID NO: 536 - protein, 108 aa, Artificial Sequence
  Synthetic
  BCMA-26 VL chain (aa)
SYVLTQPPSVSVAPGQTARITCGANNIGSKSVHWYQQKPGQAPMLVVYDDDDRPSGIPERFSGSNSGNTATLTISGVEAGDEADYFCHLWDRSRDHYVFGTGTKLTVL

SEQ ID NO: 537 - protein, 113 aa, Artificial Sequence
  Synthetic
  BCMA-28 VL chain (aa)
DIVMTQSPLSLSVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKVEIK

SEQ ID NO: 538 - protein, 112 aa, Artificial Sequence
  Synthetic
  BCMA-29 VL chain (aa)
  VARIANT 105: Xaa = any amino acid
QPVLTQPASVSGSPGQSITISCTGTSSDVGSYNLVSWYQQHPGKAPKLMIYEVSKRPSGVSNRFSGSKSGNTASPTISGLQAEDEADYYCCSYAGSSTSRDVFGXGTKLTVL

SEQ ID NO: 539 - protein, 105 aa, Artificial Sequence
  Synthetic
  BCMA-30 VL chain (aa)
EIVLTQSPATLSVSPGERATLSCRASQPIRSNLAWYQQKPGQAPKLLIYSASTRATGIPDRFSGSGSGTDFTLTISRLEHEDFAVYYRRHYAPLTFGGGTKVEIK

SEQ ID NO: 540 - protein, 113 aa, Artificial Sequence
  Synthetic
  BCMA-31 VL chain (aa)
DVVMTQSPDSLAVSLGERATISCKSSQSVLNSSNNKNYVAWYKQKPGQPPKLVISWASTRESGVPDRFSGSGSGTDFTLTISSLQAEDVAVYYCQQYYSTPYTFGQGTKLDIK

SEQ ID NO: 541 - protein, 108 aa, Artificial Sequence
  Synthetic
  BCMA-32 VL chain (aa)
QTVVTQPPSVSVAPGQTARITCGGNNIGSKGVHWYRQRPGQAPEVVIYDDSDRPSGVPDRFSGSNSGNTATLTVRGVEAGDEADYYCQVWDSSSDHWVFGGGTKLTVL

SEQ ID NO: 542 - protein, 108 aa, Artificial Sequence
  Synthetic
  BCMA-34 VL chain (aa)
EIVMTQSPATLSLSPGDRATLSCRASQSISNYLAWYQQKPGQAPRLLIYDASNRATGIPARFSGSGSGTDFTLTISSLEPEDFAVYYCQQRSNWPPYTFGQGTKLDIK

SEQ ID NO: 543 - protein, 108 aa, Artificial Sequence
  Synthetic
  BCMA-35 VL chain (aa)
NFMLTQPPSVSVAPGQTARITCGANNIGSKSVHWYQQKPGQAPMLVVYDDDDRPSGIPERFSGSNSGNTATLTISGVEAGDEADYFCHLWDRSRDHYVFGTGTKLDIK

SEQ ID NO: 544 - protein, 110 aa, Artificial Sequence
  Synthetic
  BCMA-36 VL chain (aa)
QSVLTQEPSLTVSPGETVTLTCGSSTGPVTSAHSPSWFQKKPGQAPTTLIYETTNRHSWTPARFSGSLLGGKAALTLSGAQPEDEADYYCLLSSGDARMVFGGGTKLTVL

SEQ ID NO: 545 - protein, 110 aa, Artificial Sequence
  Synthetic
  BCMA-37 VL chain (aa)
QLVLTQEPSLTVSPGGTVTLTCGSSTGAVTNGHSPYWFQQKPGQAPRTLIYDTTNRHSWTPARFSGSLLGGKAALTLSGAQPEDEAEYYCSLSHAGDRVFFGGGTKLTVL

SEQ ID NO: 546 - protein, 110 aa, Artificial Sequence
  Synthetic
  BCMA-38 VL chain (aa)
QAVLTQEPSLTVSPGGTVTLTCGSSTGAVTNGHSPYWFQQKPGQAPRTLIYDTNNRHSWTPARFSGSLLGGKAALTLSGAQPEDEADYFCLLSYSDARLAFGGGTKLTVL

SEQ ID NO: 547 - protein, 107 aa, Artificial Sequence
  Synthetic
  BCMA-39 VL chain (aa)
  VARIANT 4: Xaa = any amino acid
  VARIANT 34: Xaa = any amino acid
DIQXTQSPSSLSASVGDRVTITCRASQGIRYELXWYQQKPGKAPKLLIYAASTLQSGVPSRFSGSGSGTDFALTIRSLQPEDFATYYCLQHNSYPLTFGRGTKLEIK

SEQ ID NO: 548 - protein, 110 aa, Artificial Sequence
  Synthetic
  BCMA-40 VL chain (aa)
QSALTQPASVSGSPGQSITISCTGSSSDVSKYNLVSWYQQPPGKAPKLIIYDVNKRPSGVSNRFSGSKSGNTATLTISGLQGDDEADYYCCSYGGSRSYVFGTGTKLTVL

SEQ ID NO: 549 - protein, 110 aa, Artificial Sequence
  Synthetic
  BCMA-41 VL chain (aa)
QPVLTQPPSVSGTPGQRVTIPCSGSSSNIGGNSVDWFQEVPGTAPKLLIYANDRRPSGVPDRFSGTKSGTSASLAIRGLQSDDDAHYYCESWDDALNGHVFGGGTKLTVL

SEQ ID NO: 550 - protein, 107 aa, Artificial Sequence
  Synthetic
  BCMA-42 VL chain (aa)
DIQMTQSPSLVSASVGDRVTITCRASQGIGNGLAWYQQKPGKAPKLLLFAASRLESGVPSRFSGSRSGTDYTLTISSLQPEDVATYYCQQYVEDALTFGGGTKVDIK

SEQ ID NO: 551 - protein, 6 aa, Artificial Sequence
  Synthetic
  BCMA-52 CDR-H2 (aa) - Chothia numbering
YPGDSD

SEQ ID NO: 552 - protein, 113 aa, Artificial Sequence
  Synthetic
  BCMA-44 VL chain (aa)
DVVMTQSPDSLAVSLGERATINCKSSQNLLYSSNNKNYLAWYQQKPGQPPKLLIYWASTRESGVPDRFSGSGSGTDFTLTISSLQAEDVAVYYCQQYYSSPYTFGQGTKLEIK

SEQ ID NO: 553 - protein, 107 aa, Artificial Sequence
  Synthetic
  BCMA-45 VL chain (aa)
AIRMTQSPSSLSASVGDRVTITCRASQGIGRSLAWYKQKPGGVPQLLIHDASSLRSGVPSRFSGSGSGTEFTLTISGVQSEDSATYHCQQLNGYPWTFGQGTKVDIK

SEQ ID NO: 554 - protein, 108 aa, Artificial Sequence
  Synthetic
  BCMA-47 VL chain (aa)
QAVLTQPPSVSVAPGKTATITCGGNNIGSKSVHWYQRKPGQGPVVVIQYDTDRPSGIPERFSGSKSGDTASLTISGVEAGDEADYYCQLWDSDSDDFAFGTGTKLTVL

SEQ ID NO: 555 - protein, 108 aa, Artificial Sequence
  Synthetic
  BCMA-48 VL chain (aa)
QPVLTQPPSVSVAPGKTATITCGGNNIGSKSVHWYQRKPGQGPVVVIQYDTDRPSGIPERFSGSNSGNTATLTISRVEAGDEGDYYCQVWDSSSDHWVFGGGTKLTVL

SEQ ID NO: 556 - protein, 109 aa, Artificial Sequence
  Synthetic
  BCMA-49 VL chain (aa)
LPVLTQPPSVSVAPGKTARITCGGDQIGRKSVHWYQQKPGQAPVLVMSYDSDRPSGIPERFSGSNSGNTATLTISRVEAGDEAAYYCQVWDSSTGQYVVFGGGTKLTVL

SEQ ID NO: 557 - protein, 108 aa, Artificial Sequence
  Synthetic
  BCMA-51 VL chain (aa)
AIQLTQSPSTLSASVGDRVAITCRASQNIGDWLAWYQQKPGKAPKLLIFGASILESGVPSRFSGSGSGTDFTLTISSLQPEDVAVYYCQKYDGAPPWTFGQGTKVEIK

SEQ ID NO: 558 - protein, 250 aa, Artificial Sequence
  Synthetic
  BCMA-24 scFv sequence (aa)
EVQLVQSGGGLVKPGGSLRLSCAASGFTFSDYYMSWIRQAPGKGLEWVSGISWNSGSIGYADSVKGRFTISRDNAKNSLYLQMNSLRAEDTAVYYCARDLGPPYGDDAFDIWGQGTMVTVSSGGGGSGGGGSGGGGSDIVMTQSPDSLAVSLGERATINCKSSQSVLYSSNNKNYLAWYQQKPGQPPKLLIYWGSTRESGVPDRFSGSGSGTDFTLTISSLQAEDVAIYHCQQYISLPWTFGQGTKVEIK

SEQ ID NO: 559 - protein, 240 aa, Artificial Sequence
  Synthetic
  BCMA-25 scFv sequence (aa)
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIQMTQSPAFLSASVGDRVTVTCRASQGISNYLAWYQQKPGNAPRLLIYSASTLQSGVPSRFRGTGYGTEFSLTIDSLQPEDFATYYCQQSYTSRQTFGPGTRLDIK

SEQ ID NO: 560 - protein, 241 aa, Artificial Sequence
  Synthetic
  BCMA-26 scFv sequence (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSSGGGGSGGGGSGGGGSSYVLTQPPSVSVAPGQTARITCGANNIGSKSVHWYQQKPGQAPMLVVYDDDDRPSGIPERFSGSNSGNTATLTISGVEAGDEADYFCHLWDRSRDHYVFGTGTKLTVL

SEQ ID NO: 561 - protein, 240 aa, Artificial Sequence
  Synthetic
  BCMA-27 scFv sequence (aa)
EVQLLESGGGLVQPGRSLRLSCVASGFTFDDYAMHWVRQAPGKGLEWVSGISWNSGSIGYADSVKGRFTISRDNAKNSLYLQMNSLRAEDTALYYCAKGGLGITPYYFDYWGQGTLVTVSSGGGGSGGGGSGGGGSQPVLTQPPSASGTPGQRVTISCSGGKTVNWFRQVPGTAPQLLIYSNDQRPSGVPDRFSGSKSGSSASLDISGLQSEDEAYYYCGSWDDSLNAWVFGGETKLTVL

SEQ ID NO: 562 - protein, 250 aa, Artificial Sequence
  Synthetic
  BCMA-28 scFv sequence (aa)
  VARIANT 59: Xaa = any amino acid
QVQLVQSGGGLVQPGRSLRLSCAASGFTFDDYAMHWVRQAPGKGLEWVSGISWNSGSIXYADSVKGRFTISRDNAKNSLYLQMNSLRAEDTAVYYCARDLGPPYGDDAFDIGGQGTMVTVSSGGGGSGGGGSGGGGSDIVMTQSPLSLSVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKVEIK

SEQ ID NO: 563 - protein, 249 aa, Artificial Sequence
  Synthetic
  BCMA-29 scFv sequence (aa)
  VARIANT 242: Xaa = any amino acid
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDLGPPYGDDAFDIWGQGTMVTVSSGGGGSGGGGSGGGGSQPVLTQPASVSGSPGQSITISCTGTSSDVGSYNLVSWYQQHPGKAPKLMIYEVSKRPSGVSNRFSGSKSGNTASPTISGLQAEDEADYYCCSYAGSSTSRDVFGXGTKLTVL

SEQ ID NO: 564 - protein, 239 aa, Artificial Sequence
  Synthetic
  BCMA-30 scFv sequence (aa)
QVQLVQSGGGLVQPGRSLRLSCAASGFTFGDYAMHWVRQAPGKGLEWVSGISWNSGSIGYADSVKGRFTISRDNAKNSLYLQMNSLRAEDTAVYYCARDLDPDDAFDIWGQGTMVTVSSGGGGSGGGGSGGGGSEIVLTQSPATLSVSPGERATLSCRASQPIRSNLAWYQQKPGQAPKLLIYSASTRATGIPDRFSGSGSGTDFTLTISRLEHEDFAVYYRRHYAPLTFGGGTKVEIK

SEQ ID NO: 565 - protein, 246 aa, Artificial Sequence
  Synthetic
  BCMA-31 scFv sequence (aa)
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDVVMTQSPDSLAVSLGERATISCKSSQSVLNSSNNKNYVAWYKQKPGQPPKLVISWASTRESGVPDRFSGSGSGTDFTLTISSLQAEDVAVYYCQQYYSTPYTFGQGTKLDIK

SEQ ID NO: 566 - protein, 241 aa, Artificial Sequence
  Synthetic
  BCMA-32 scFv sequence (aa)
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSSGGGGSGGGGSGGGGSQTVVTQPPSVSVAPGQTARITCGGNNIGSKGVHWYRQRPGQAPEVVIYDDSDRPSGVPDRFSGSNSGNTATLTVRGVEAGDEADYYCQVWDSSSDHWVFGGGTKLTVL

SEQ ID NO: 567 - protein, 240 aa, Artificial Sequence
  Synthetic
  BCMA-33 scFv sequence (aa)
QVQLVQSGGGLVKPGGSLRLSCAASGFTFSDYYMSWIRQAPGKGLEWVSYISGSGSTIYYADSVKGRFTISRDNAKNSLYLQMNSLRAEDTAVYYCAREADSSADYWGQGTLVNVSSGGGGSGGGGSGGGGSQPVLTQPPSVSVAPGKTAMITCGGNNIGFKGVQWYQQKTGQAPVLVVYDDSDRPSGIPERFSGSNSGNTATLTISRVEAGDEADYYCQVWDSASDHWVFGGGTKLTVL

SEQ ID NO: 568 - protein, 245 aa, Artificial Sequence
  Synthetic
  BCMA-34 scFv sequence (aa)
TGQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDLGPDYDPDAFDIWGQGTMVTVSSGGGGSGGGGSGGGGSEIVMTQSPATLSLSPGDRATLSCRASQSISNYLAWYQQKPGQAPRLLIYDASNRATGIPARFSGSGSGTDFTLTISSLEPEDFAVYYCQQRSNWPPYTFGQGTKLDIK

SEQ ID NO: 569 - protein, 240 aa, Artificial Sequence
  Synthetic
  BCMA-35 scFv sequence (aa)
EVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYDDYWGQGTLVTVSSGGGGSGGGGSGGGGSNFMLTQPPSVSVAPGQTARITCGANNIGSKSVHWYQQKPGQAPMLVVYDDDDRPSGIPERFSGSNSGNTATLTISGVEAGDEADYFCHLWDRSRDHYVFGTGTKLDIK

SEQ ID NO: 570 - protein, 243 aa, Artificial Sequence
  Synthetic
  BCMA-36 scFv sequence (aa)
QVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYVDDYWGQGTLVTVSSGGGGSGGGGSGGGGSQSVLTQEPSLTVSPGETVTLTCGSSTGPVTSAHSPSWFQKKPGQAPTTLIYETTNRHSWTPARFSGSLLGGKAALTLSGAQPEDEADYYCLLSSGDARMVFGGGTKLTVL

SEQ ID NO: 571 - protein, 243 aa, Artificial Sequence
  Synthetic
  BCMA-37 scFv sequence (aa)
EVQLVQSGGGLVKPGGSLRLSCAASGFTFSDYYMSWIRQAPGKGLEWVSYISSSGSTIYYADSVKGRFTISRDNAKSSLYLQMNSLRAEDTAVYYCARVDGDYVDDYWGQGTLVTVSSGGGGSGGGGSGGGGSQLVLTQEPSLTVSPGGTVTLTCGSSTGAVTNGHSPYWFQQKPGQAPRTLIYDTTNRHSWTPARFSGSLLGGKAALTLSGAQPEDEAEYYCSLSHAGDRVFFGGGTKLTVL

SEQ ID NO: 572 - protein, 243 aa, Artificial Sequence
  Synthetic
  BCMA-38 scFv sequence (aa)
QVQLVQSGGGLVKPGGSLRLSCAASGFTFSDYYMSWIRQAPGKGLEWVSYISSSGSTIYYADSVKGRFTISRDNAKNSLYLQMNSLRAEDTAVYYCARVDGDYVDDYWGQGTLVTVSSGGGGSGGGGSGGGGSQAVLTQEPSLTVSPGGTVTLTCGSSTGAVTNGHSPYWFQQKPGQAPRTLIYDTNNRHSWTPARFSGSLLGGKAALTLSGAQPEDEADYFCLLSYSDARLAFGGGTKLTVL

SEQ ID NO: 573 - protein, 244 aa, Artificial Sequence
  Synthetic
  BCMA-39 scFv sequence (aa)
  VARIANT 141: Xaa = any amino acid
  VARIANT 171: Xaa = any amino acid
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDLGPPYGDDAFDIWGQGTMVTVSSGGGGSGGGGSGGGGSDIQXTQSPSSLSASVGDRVTITCRASQGIRYELXWYQQKPGKAPKLLIYAASTLQSGVPSRFSGSGSGTDFALTIRSLQPEDFATYYCLQHNSYPLTFGRGTKLEIK

SEQ ID NO: 574 - protein, 243 aa, Artificial Sequence
  Synthetic
  BCMA-40 scFv sequence (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGDYTEDYWGQGTLVTVSSGGGGSGGGGSGGGGSQSALTQPASVSGSPGQSITISCTGSSSDVSKYNLVSWYQQPPGKAPKLIIYDVNKRPSGVSNRFSGSKSGNTATLTISGLQGDDEADYYCCSYGGSRSYVFGTGTKLTVL

SEQ ID NO: 575 - protein, 243 aa, Artificial Sequence
  Synthetic
  BCMA-41 scFv sequence (aa)
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCAKVDGDYVDDYWGQGTLVTVSSGGGGSGGGGSGGGGSQPVLTQPPSVSGTPGQRVTIPCSGSSSNIGGNSVDWFQEVPGTAPKLLIYANDRRPSGVPDRFSGTKSGTSASLAIRGLQSDDDAHYYCESWDDALNGHVFGGGTKLTVL

SEQ ID NO: 576 - protein, 240 aa, Artificial Sequence
  Synthetic
  BCMA-42 scFv sequence (aa)
EVQLLESGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIQMTQSPSLVSASVGDRVTITCRASQGIGNGLAWYQQKPGKAPKLLLFAASRLESGVPSRFSGSRSGTDYTLTISSLQPEDVATYYCQQYVEDALTFGGGTKVDIK

SEQ ID NO: 577 - protein, 10 aa, Artificial Sequence
  Synthetic
  BCMA-52 CDR-H1 (aa) - AbM numbering
GYSFTSYWIG

SEQ ID NO: 578 - protein, 246 aa, Artificial Sequence
  Synthetic
  BCMA-44 scFv sequence (aa)
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDVVMTQSPDSLAVSLGERATINCKSSQNLLYSSNNKNYLAWYQQKPGQPPKLLIYWASTRESGVPDRFSGSGSGTDFTLTISSLQAEDVAVYYCQQYYSSPYTFGQGTKLEIK

SEQ ID NO: 579 - protein, 240 aa, Artificial Sequence
  Synthetic
  BCMA-45 scFv sequence (aa)
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSAIRMTQSPSSLSASVGDRVTITCRASQGIGRSLAWYKQKPGGVPQLLIHDASSLRSGVPSRFSGSGSGTEFTLTISGVQSEDSATYHCQQLNGYPWTFGQGTKVDIK

SEQ ID NO: 580 - protein, 241 aa, Artificial Sequence
  Synthetic
  BCMA-47 scFv sequence (aa)
QVQLLESGGGLVKPGGSLRLSCAASGFTFSDYYMSWIRQAPGKGLEWVSYISSSGSTIYYADSVKGDSPSPGTTPKNSLYLQMNSLRAEDTAVYYCAKVDGPPSFDIWRQGTMVTVSSGGGGSGGGGSGGGGSQAVLTQPPSVSVAPGKTATITCGGNNIGSKSVHWYQRKPGQGPVVVIQYDTDRPSGIPERFSGSKSGDTASLTISGVEAGDEADYYCQLWDSDSDDFAFGTGTKLTVL

SEQ ID NO: 581 - protein, 241 aa, Artificial Sequence
  Synthetic
  BCMA-48 scFv sequence (aa)
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSSGGGGSGGGGSGGGGSQPVLTQPPSVSVAPGKTATITCGGNNIGSKSVHWYQRKPGQGPVVVIQYDTDRPSGIPERFSGSNSGNTATLTISRVEAGDEGDYYCQVWDSSSDHWVFGGGTKLTVL

SEQ ID NO: 582 - protein, 242 aa, Artificial Sequence
  Synthetic
  BCMA-49 scFv sequence (aa)
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSSGGGGSGGGGSGGGGSLPVLTQPPSVSVAPGKTARITCGGDQIGRKSVHWYQQKPGQAPVLVMSYDSDRPSGIPERFSGSNSGNTATLTISRVEAGDEAAYYCQVWDSSTGQYVVFGGGTKLTVL

SEQ ID NO: 583 - protein, 241 aa, Artificial Sequence
  Synthetic
  BCMA-51 scFv sequence (aa)
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSAIQLTQSPSTLSASVGDRVAITCRASQNIGDWLAWYQQKPGKAPKLLIFGASILESGVPSRFSGSGSGTDFTLTISSLQPEDVAVYYCQKYDGAPPWTFGQGTKVEIK

SEQ ID NO: 584 - DNA, 729 bp, Artificial Sequence
  Synthetic
  BCMA-41 scFv sequence (nt)
caggtgcagctggtgcaatctgggggaggcttggtcaagcctggagggtccctgagactctcctgtgcagcctctggattcaccttcagtgactactacatgagctggatccgccaggctccagggaaggggctggagtgggtttcatacattagtagtagtggtaataccatatactacgcagactctgtaaagggccgattcaccatctccagggacaacgccaaaaactcactgtatctgcaaatgaacagcctgagagccgaggacacggccgtgtattactgtgcgaaagtggacggtgactacgtcgatgactactggggccagggaaccctggtcaccgtctcctcaggtggaggcggttcaggcggaggtggctctggcggtggcggatcgcagcctgtgctgactcagccaccctcagtgtctgggacccccgggcagagggtcaccatcccttgttctggaagcagctccaacatcggaggtaactctgtagactggttccaggaggtcccagggacggcccccaaactcctcatctacgctaatgatcggcggccctcgggtgtccctgaccgcttctctggcaccaagtcgggcacctcagcctccctggccatcagggggctccagtctgacgatgacgctcattattactgtgaatcctgggacgatgccctgaacggtcacgtgttcggcggagggaccaagctgaccgtccta

SEQ ID NO: 585 - protein, 243 aa, Artificial Sequence
  Synthetic
  BCMA-C1 VH-VL scFv (aa)
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK

SEQ ID NO: 586 - protein, 244 aa, Artificial Sequence
  Synthetic
  BCMA-C2  VL-VH scFv (aa)
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 587 - protein, 10 aa, Artificial Sequence
  Synthetic
  BCMA-52 CDR-H2 (aa) - AbM numbering
IIYPGDSDTR

SEQ ID NO: 588 - DNA, 348 bp, Artificial Sequence
  Synthetic
  BCMA-52 VH chain (nt)  (O/SSE)
gaagtgcagctggtgcagtctggcgccgaagtgaagaagcctggcgagagcctgaagatcagctgcaaaggcagcggctacagcttcaccagctactggatcggctgggtccgacagatgcctggcaaaggccttgagtggatgggcatcatctaccccggcgacagcgacaccagatacagccctagctttcagggccacgtgaccatcagcgccgacaagtctatcagcaccgcctacctgcagtggtccagcctgaaggcctctgacaccgccatgtactactgcgccagatactctggcagcttcgacaattggggccagggcacactggtcaccgtgtccagc

SEQ ID NO: 589 - protein, 13 aa, Artificial Sequence
  Synthetic
  BCMA-52 CDR-L1 (aa) - Kabat, Chothia, and AbM numbering
SGTSSNIGSHSVN

SEQ ID NO: 590 - protein, 7 aa, Artificial Sequence
  Synthetic
  BCMA-52 CDR-L2 (aa) - Kabat, Chothia, and AbM numbering
TNNQRPS

SEQ ID NO: 591 - protein, 11 aa, Artificial Sequence
  Synthetic
AAWDGSLNGLV

SEQ ID NO: 592 - DNA, 333 bp, Artificial Sequence
  Synthetic
  BCMA-52 VL chain (nt)
tcctatgagctgactcagccaccctcagcgtctgggacccccgggcagagggtcaccatgtcttgttctggaaccagctccaacatcggaagtcactctgtaaactggtaccagcagctcccaggaacggcccccaaactcctcatctatactaataatcagcggccctcaggggtccctgaccgattctctggctccaagtctggcacctcagcctccctggccatcagtggcctccagtctgaggatgaggctgattattactgtgcagcatgggatggcagcctgaatggtctggtattcggcggagggaccaagctgaccgtcctaggt

SEQ ID NO: 593 - protein, 5 aa, Artificial Sequence
  Synthetic
  BCMA-55 CDR-H1 (aa) - Kabat numbering
DYYVY

SEQ ID NO: 594 - protein, 17 aa, Artificial Sequence
  Synthetic
  BCMA-55 CDR-H2 (aa) - Kabat numbering
WINPNSGGTNYAQKFQG

SEQ ID NO: 595 - protein, 9 aa, Artificial Sequence
  Synthetic
  BCMA-55 CDR-H3 (aa) - Kabat, Chothia, and AbM numbering
SQRDGYMDY

SEQ ID NO: 596 - protein, 7 aa, Artificial Sequence
  Synthetic
  BCMA-55 CDR-H1 (aa) - Chothia numbering
GYTFIDY

SEQ ID NO: 597 - protein, 6 aa, Artificial Sequence
  Synthetic
  BCMA-55 CDR-H2 (aa) - Chothia numbering
NPNSGG

SEQ ID NO: 598 - protein, 10 aa, Artificial Sequence
  Synthetic
  BCMA-55 CDR-H1 (aa) - AbM numbering
GYTFIDYYVY

SEQ ID NO: 599 - protein, 10 aa, Artificial Sequence
  Synthetic
  BCMA-55 CDR-H2 (aa) - AbM numbering
WINPNSGGTN

SEQ ID NO: 600 - DNA, 333 bp, Artificial Sequence
  Synthetic
  BCMA-52 VL chain (nt) (O/SSE)
agctatgagctgacacagcctccaagcgcctctggcacacctggacagcgagtgacaatgagctgtagcggcaccagcagcaacatcggcagccacagcgtgaactggtatcagcagctgcctggcacagcccctaaactgctgatctacaccaacaaccagcggcctagcggcgtgcccgatagattttctggcagcaagagcggcacaagcgccagcctggctatttctggactgcagagcgaggacgaggccgactattattgtgccgcctgggacggctctctgaacggccttgtttttggcggaggcaccaagctgacagtgctggga

SEQ ID NO: 601 - protein, 8 aa, Artificial Sequence
  Synthetic
  BCMA-55 CDR-L1 (aa) - Kabat, Chothia, and AbM numbering
TGTSSDVG

SEQ ID NO: 602 - protein, 7 aa, Artificial Sequence
  Synthetic
  BCMA-55 CDR-L2 (aa) - Kabat, Chothia, and AbM numbering
EDSKRPS

SEQ ID NO: 603 - protein, 10 aa, Artificial Sequence
  Synthetic
  BCMA-55 CDR-L3 (aa) - Kabat, Chothia, and AbM numbering
SSNTRSSTLV

SEQ ID NO: 604 - protein, 8 aa, Artificial Sequence
  Synthetic
  BCMA-52 CDR-H1 (aa)
GYSFTSYW

SEQ ID NO: 605 - protein, 8 aa, Artificial Sequence
  Synthetic
  BCMA-52 CDR-H2 (aa)
IYPGDSDT

SEQ ID NO: 606 - protein, 9 aa, Artificial Sequence
  Synthetic
  BCMA-52 CDR-H3 (aa)
ARYSGSFDN

SEQ ID NO: 607 - protein, 8 aa, Artificial Sequence
  Synthetic
  BCMA-52 CDR-L1 (aa)
SSNIGSHS

SEQ ID NO: 608 - protein, 3 aa, Artificial Sequence
  Synthetic
  BCMA-52 CDR-L2 (aa)
TNN

SEQ ID NO: 609 - protein, 116 aa, Artificial Sequence
  Synthetic
  BCMA-52 VH chain (aa)
EVQLVQSGAEVKKPGESLKISCKGSGYSFTSYWIGWVRQMPGKGLEWMGIIYPGDSDTRYSPSFQGHVTISADKSISTAYLQWSSLKASDTAMYYCARYSGSFDNWGQGTLVTVSS

SEQ ID NO: 610 - protein, 111 aa, Artificial Sequence
  Synthetic
  BCMA-52 VL chain (aa)
SYELTQPPSASGTPGQRVTMSCSGTSSNIGSHSVNWYQQLPGTAPKLLIYTNNQRPSGVPDRFSGSKSGTSASLAISGLQSEDEADYYCAAWDGSLNGLVFGGGTKLTVLG

SEQ ID NO: 611 - protein, 8 aa, Artificial Sequence
  Synthetic
  BCMA-55 CDR-H1 (aa)
GYTFIDYY

SEQ ID NO: 612 - protein, 8 aa, Artificial Sequence
  Synthetic
  BCMA-55 CDR-H2 (aa)
INPNSGGT

SEQ ID NO: 613 - protein, 11 aa, Artificial Sequence
  Synthetic
  BCMA-55 CDR-H3 (aa)
ARSQRDGYMDY

SEQ ID NO: 614 - protein, 9 aa, Artificial Sequence
  Synthetic
  BCMA-55 CDR-L1 (aa)
ISCTGTSSD

SEQ ID NO: 615 - protein, 3 aa, Artificial Sequence
  Synthetic
  BCMA-55 CDR-L2 (aa)
EDS

SEQ ID NO: 616 - DNA, 15 bp, Artificial Sequence
  Synthetic
  predicted splice donor site
tcaattggtacgtgg

SEQ ID NO: 617 - protein, 118 aa, Artificial Sequence
  Synthetic
  BCMA-55 VH chain (aa)
EVQLVQSGAEMKKPGASLKLSCKASGYTFIDYYVYWMRQAPGQGLESMGWINPNSGGTNYAQKFQGRVTMTRDTSISTAYMELSRLRSDDTAMYYCARSQRDGYMDYWGQGTLVTVSS

SEQ ID NO: 618 - protein, 105 aa, Artificial Sequence
  Synthetic
  BCMA-55 VL chain (aa)
QSALTQPASVSASPGQSIAISCTGTSSDVGWYQQHPGKAPKLMIYEDSKRPSGVSNRFSGSKSGNTASLTISGLQAEDEADYYCSSNTRSSTLVFGGGTKLTVLG

SEQ ID NO: 619 - DNA, 60 bp, Homo sapiens
  human IgG -kappa signal sequence (nt)
atggtgctgcagacccaggtgttcatcagcctgctgctgtggatctccggagcatacgga

SEQ ID NO: 620 - protein, 20 aa, Homo sapiens
  human IgG -kappa signal sequence (aa)
MVLQTQVFISLLLWISGAYG

SEQ ID NO: 621 - DNA, 684 bp, Artificial Sequence
  Synthetic
  gG4/IgG2 hinge- IgG2/IgG4 CH2- IgG4 CH3 spacer (nt)
gaatctaagtacggaccgccctgccctccctgccctgctcctcctgtggctggaccaagcgtgttcctgtttccacctaagcctaaagataccctgatgatttcccgcacacctgaagtgacttgcgtggtcgtggacgtgagccaggaggatccagaagtgcagttcaactggtacgtggacggcgtggaagtccacaatgctaagactaaaccccgagaggaacagtttcagtcaacttaccgggtcgtgagcgtgctgaccgtcctgcatcaggattggctgaacgggaaggagtataagtgcaaagtgtctaataagggactgcctagctccatcgagaaaacaattagtaaggcaaaagggcagcctcgagaaccacaggtgtataccctgccccctagccaggaggaaatgaccaagaaccaggtgtccctgacatgtctggtcaaaggcttctatccaagtgacatcgccgtggagtgggaatcaaatgggcagcccgagaacaattacaagaccacaccacccgtgctggactctgatggaagtttctttctgtattccaggctgaccgtggataaatctcgctggcaggagggcaacgtgttctcttgcagtgtcatgcacgaagccctgcacaatcattatacacagaagtcactgagcctgtccctgggcaaa

SEQ ID NO: 622 - DNA, 684 bp, Artificial Sequence
  Synthetic
  optimized SSE IgG4/IgG2 hinge- IgG2/IgG4 CH2- IgG4 CH3 spacer (nt)
gagtctaaatacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaag

SEQ ID NO: 623 - DNA, 84 bp, Artificial Sequence
  Synthetic
  CD28 transmembrane domain (nt)
atgttttgggtgctggtcgtggtcggaggggtgctggcctgttacagcctgctggtgacagtcgctttcatcatcttctgggtg

SEQ ID NO: 624 - protein, 28 aa, Artificial Sequence
  Synthetic
  CD28 transmembrane domain (aa)
MFWVLVVVGGVLACYSLLVTVAFIIFWV

SEQ ID NO: 625 - DNA, 126 bp, Artificial Sequence
  Synthetic
  4-1BB-derived intracellular co-signaling sequence (nt)
aagcgggggagaaagaaactgctgtatattttcaaacagccctttatgagacctgtgcagactacccaggaggaagacggatgcagctgtaggtttcccgaggaagaggaaggaggctgtgagctg

SEQ ID NO: 626 - protein, 42 aa, Artificial Sequence
  Synthetic
  4-1BB-derived intracellular co-signaling sequence (aa)
KRGRKKLLYIFKQPFMRPVQTTQEEDGCSCRFPEEEEGGCEL

SEQ ID NO: 627 - DNA, 336 bp, Artificial Sequence
  Synthetic
  CD3-zeta derived intracellular signaling domain (nt)
agagtcaagttttccaggtccgccgacgctccagcctaccagcaggggcagaaccagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaagg

SEQ ID NO: 628 - protein, 112 aa, Artificial Sequence
  Synthetic
  CD3-zeta derived intracellular signaling domain (aa)
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 629 - DNA, 117 bp, Artificial Sequence
  Synthetic
  CD28 ectodomain spacer (nt)
attgaagttatgtatcctcctccttacctagacaatgagaagagcaatggaaccattatccatgtgaaagggaaacacctttgtccaagtcccctatttcccggaccttctaagccc

SEQ ID NO: 630 - protein, 39 aa, Artificial Sequence
  Synthetic
  CD28 ectodomain spacer (aa)
IEVMYPPPYLDNEKSNGTIIHVKGKHLCPSPLFPGPSKP

SEQ ID NO: 631 - protein, 18 aa, Artificial Sequence
  Synthetic
  T2A peptide (aa)
EGRGSLLTCGDVEENPGP

SEQ ID NO: 632 - DNA, 1074 bp, Artificial Sequence
  Synthetic
  truncated EGFR (tEGFR) sequence (nt)
atgcttctcctggtgacaagccttctgctctgtgagttaccacacccagcattcctcctgatcccacgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgtga

SEQ ID NO: 633 - DNA, 1074 bp, Artificial Sequence
  Synthetic
  truncated EGFR (tEGFR) sequence (nt) (O/SSE)
atgctgctcctcgtgacaagcctgctcctgtgtgaactccctcatccagcttttctgctcattcctcggaaagtgtgcaacggcatcggcatcggagagttcaaggacagcctgagcatcaatgccaccaacatcaagcacttcaagaattgcaccagcatcagcggcgacctgcacattctgcctgtggcctttagaggcgacagcttcacccacacacctccactggatccccaagagctggatatcctgaaaaccgtgaaagagattaccggattcctcctgatccaagcctggccagagaacagaaccgatctgcacgccttcgagaacctcgagatcatcagaggccggaccaaacagcacggccagtttagcctggctgtggtgtctctgaacatcaccagtctgggcctgagaagcctgaaagaaatctccgacggcgacgtgatcatctccggaaacaagaacctgtgctacgccaacaccatcaactggaagaagctgttcggcacctccggccagaaaacaaagatcatctctaaccggggcgagaacagctgcaaggccaccggacaagtttgtcacgccctgtgtagccctgaaggctgttggggacccgaacctagagactgtgtgtcctgccggaatgtgtcccggggcagagaatgtgtggataagtgcaacctgctggaaggcgagccccgcgagtttgtggaaaacagcgagtgcatccagtgtcaccccgagtgtctgccccaggccatgaacattacatgcaccggcagaggccccgacaactgtattcagtgcgcccactacatcgacggccctcactgcgtgaaaacatgtccagctggcgtgatgggagagaacaacaccctcgtgtggaagtatgccgacgccggacatgtgtgccacctgtgtcaccctaattgcacctacggctgtaccggacctggcctggaaggatgccctacaaacggccctaagatccccagcattgccaccggaatggttggagccctgctgcttctgttggtggtggccctcggaatcggcctgttcatgtga

SEQ ID NO: 634 - protein, 357 aa, Artificial Sequence
  Synthetic
  truncated EGFR (tEGFR) sequence (aa)
MLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 635 - DNA, 544 bp, Artificial Sequence
  Synthetic
  EF1alpha promoter with HTLV1 enhancer
ggatctgcgatcgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctac

SEQ ID NO: 636 - DNA, 589 bp, Artificial Sequence
  Synthetic
  Woodchuck Hepatitis Virus (WHP) Posttranscriptional Regulatory Element (WPRE)
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgc

SEQ ID NO: 637 - protein, 5 aa, Artificial Sequence
  Synthetic
  BCMA-52-scFV-mFc BCMA binding epitope 1
QNEYF

SEQ ID NO: 638 - protein, 6 aa, Artificial Sequence
  Synthetic
  BCMA-52-scFV-mFc BCMA binding epitope 2
CIPCQL

SEQ ID NO: 639 - protein, 5 aa, Artificial Sequence
  Synthetic
  BCMA-52-scFV-mFc BCMA binding epitope 3
CQRYC

SEQ ID NO: 640 - protein, 5 aa, Artificial Sequence
  Synthetic
  BCMA-55-scFV-mFc BCMA binding epitope 1
MLMAG

SEQ ID NO: 641 - protein, 6 aa, Artificial Sequence
  Synthetic
  BCMA-55-scFV-mFc BCMA binding epitope 2
YFDSLL

SEQ ID NO: 642 - protein, 11 aa, Artificial Sequence
  Synthetic
  BCMA-55-scFV-mFc BCMA binding epitope 3
QLRCSSNTPPL

SEQ ID NO: 643 - DNA, 354 bp, Artificial Sequence
  Synthetic
  BCMA-55 VH chain (nt)
gaagtgcagctggtgcagtctggggctgagatgaagaagcctggggcctcactgaagctctcctgcaaggcttctggatacaccttcatcgactactatgtatactggatgcgacaggcccctggacaagggcttgagtccatgggatggatcaaccctaacagtggtggcacaaactatgcacagaagtttcagggcagggtcaccatgaccagggacacgtccatcagcacagcctacatggagctgagcaggctgagatctgacgacaccgccatgtattactgtgcgcgctcccagcgtgacggttacatggattactggggtcaaggtactctggtgaccgtctcctca

SEQ ID NO: 644 - DNA, 354 bp, Artificial Sequence
  Synthetic
  BCMA-55 VH chain (nt) (O/SSE)
gaagtgcagctggtgcagtctggcgccgagatgaagaaacctggcgcctctctgaagctgagctgcaaggccagcggctacaccttcatcgactactacgtgtactggatgcggcaggcccctggacagggactcgaatctatgggctggatcaaccccaatagcggcggcaccaattacgcccagaaattccagggcagagtgaccatgaccagagacaccagcatcagcaccgcctacatggaactgagccggctgagatccgacgacaccgccatgtactactgcgccagatctcagcgcgacggctacatggattattggggccagggaaccctggtcaccgtgtccagc

SEQ ID NO: 645 - DNA, 312 bp, Artificial Sequence
  Synthetic
  BCMA-55 VL chain (nt)
caatctgccctgactcagcctgcctccgtgtctgcgtctcctggacagtcgatcgccatctcctgcactggaaccagcagtgacgttggttggtatcaacagcacccaggcaaagcccccaaactcatgatttatgaggacagtaagcggccctcaggggtttctaatcgcttctctggctccaagtctggcaacacggcctccctgaccatctctgggctccaggctgaggacgaggctgattattactgcagctcaaatacaagaagcagcactttggtgttcggcggagggaccaagctgaccgtccta

SEQ ID NO: 646 - DNA, 312 bp, Artificial Sequence
  Synthetic
  BCMA-55 VL chain (nt) (O/SSE)
cagtctgccctgacacagcctgccagcgttagtgctagtcccggacagtctatcgccatcagctgtaccggcaccagctctgacgttggctggtatcagcagcaccctggcaaggcccctaagctgatgatctacgaggacagcaagaggcccagcggcgtgtccaatagattcagcggcagcaagagcggcaacaccgccagcctgacaattagcggactgcaggccgaggacgaggccgattactactgcagcagcaacacccggtccagcacactggtttttggcggaggcaccaagctgacagtgctg

SEQ ID NO: 647 - DNA, 744 bp, Artificial Sequence
  Synthetic
  BCMA-52 scFv
tcctatgagctgactcagccaccctcagcgtctgggacccccgggcagagggtcaccatgtcttgttctggaaccagctccaacatcggaagtcactctgtaaactggtaccagcagctcccaggaacggcccccaaactcctcatctatactaataatcagcggccctcaggggtccctgaccgattctctggctccaagtctggcacctcagcctccctggccatcagtggcctccagtctgaggatgaggctgattattactgtgcagcatgggatggcagcctgaatggtctggtattcggcggagggaccaagctgaccgtcctaggttctagaggtggtggtggtagcggcggcggcggctctggtggtggtggatccctcgagatggccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccacgtcaccatctcagctgacaagtccatcagcactgcctacctgcagtggagcagcctgaaggcctcggacaccgccatgtattactgtgcgcgctactctggttctttcgataactggggtcaaggtactctggtgaccgtctcctca

SEQ ID NO: 648 - DNA, 732 bp, Artificial Sequence
  Synthetic
  BCMA-55 scFv
caatctgccctgactcagcctgcctccgtgtctgcgtctcctggacagtcgatcgccatctcctgcactggaaccagcagtgacgttggttggtatcaacagcacccaggcaaagcccccaaactcatgatttatgaggacagtaagcggccctcaggggtttctaatcgcttctctggctccaagtctggcaacacggcctccctgaccatctctgggctccaggctgaggacgaggctgattattactgcagctcaaatacaagaagcagcactttggtgttcggcggagggaccaagctgaccgtcctaggttctagaggtggtggtggtagcggcggcggcggctctggtggtggtggatccctcgagatggccgaagtgcagctggtgcagtctggggctgagatgaagaagcctggggcctcactgaagctctcctgcaaggcttctggatacaccttcatcgactactatgtatactggatgcgacaggcccctggacaagggcttgagtccatgggatggatcaaccctaacagtggtggcacaaactatgcacagaagtttcagggcagggtcaccatgaccagggacacgtccatcagcacagcctacatggagctgagcaggctgagatctgacgacaccgccatgtattactgtgcgcgctcccagcgtgacggttacatggattactggggtcaaggtactctggtgaccgtctcctca

SEQ ID NO: 649 - protein, 228 aa, Artificial Sequence
  Synthetic
  IgG4/IgG2 hinge- IgG2/IgG4 CH2- IgG4 CH3 spacer (aa)
ESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 650 - DNA, 554 bp, Artificial Sequence
  Synthetic
  modified EF1 alpha promoter
ggatctgcgatcgctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacggctagcgcc

SEQ ID NO: 651 - DNA, 399 bp, Artificial Sequence
  Synthetic
  MND promoter
tttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagccca

SEQ ID NO: 652 - DNA, 336 bp, Artificial Sequence
  Synthetic
  CD3-zeta derived intracellular signaling domain (nt)
agagtgaagttcagcagatccgccgacgctccagcctatcagcagggccaaaaccagctgtacaacgagctgaacctggggagaagagaagagtacgacgtgctggataagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggcctgagcaccgccaccaaggatacctatgacgcactgcacatgcaggccctgccacctaga

SEQ ID NO: 653 - protein, 21 aa, Artificial Sequence
  Synthetic
  T2A peptide (aa)
GSGEGRGSLLTCGDVEENPGP

SEQ ID NO: 654 - protein, 24 aa, Artificial Sequence
  Synthetic
  T2A peptide (aa)
LEGGGEGRGSLLTCGDVEENPGPR

SEQ ID NO: 655 - protein, 19 aa, Artificial Sequence
  Synthetic
  P2A peptide (aa)
ATNFSLLKQAGDVEENPGP

SEQ ID NO: 656 - protein, 22 aa, Artificial Sequence
  Synthetic
  P2A peptide (aa)
GSGATNFSLLKQAGDVEENPGP

SEQ ID NO: 657 - protein, 20 aa, Artificial Sequence
  Synthetic
  E2A peptide (aa)
QCTNYALLKLAGDVESNPGP

SEQ ID NO: 658 - protein, 23 aa, Artificial Sequence
  Synthetic
  E2A peptide (aa)
GSGQCTNYALLKLAGDVESNPGP

SEQ ID NO: 659 - protein, 22 aa, Artificial Sequence
  Synthetic
  F2A peptide (aa)
VKQTLNFDLLKLAGDVESNPGP

SEQ ID NO: 660 - protein, 25 aa, Artificial Sequence
  Synthetic
  F2A peptide (aa)
GSGVKQTLNFDLLKLAGDVESNPGP

SEQ ID NO: 661 - DNA, 15 bp, Artificial Sequence
  Synthetic
  Optimized splice donor site
agtctaaatacggac

SEQ ID NO: 662 - DNA, 15 bp, Artificial Sequence
  Synthetic
  Optimized splice donor site
tcaactggtatgtgg

SEQ ID NO: 663 - DNA, 15 bp, Artificial Sequence
  Synthetic
  Optimized splice donor site
accatctccaaggcc

SEQ ID NO: 664 - DNA, 15 bp, Artificial Sequence
  Synthetic
  Optimized splice donor site
gccccaggtttacac

SEQ ID NO: 665 - DNA, 15 bp, Artificial Sequence
  Synthetic
  Optimized splice donor site
tcagcagatccgccg

SEQ ID NO: 666 - DNA, 15 bp, Artificial Sequence
  Synthetic
  Optimized splice donor site
ctcctgtgtgaactc

SEQ ID NO: 667 - DNA, 15 bp, Artificial Sequence
  Synthetic
  Optimized splice donor site
tcggaaagtgtgcaa

SEQ ID NO: 668 - DNA, 15 bp, Artificial Sequence
  Synthetic
  Optimized splice donor site
cagcacggccagttt

SEQ ID NO: 669 - DNA, 15 bp, Artificial Sequence
  Synthetic
  Optimized splice donor site
aaccggggcgagaac

SEQ ID NO: 670 - DNA, 15 bp, Artificial Sequence
  Synthetic
  Optimized splice donor site
ctggaaggcgagccc

SEQ ID NO: 671 - DNA, 15 bp, Artificial Sequence
  Synthetic
  Optimized splice donor site (last 4 nt outside of coding region)
tgttcatgtgagcgg

SEQ ID NO: 672 - DNA, 41 bp, Artificial Sequence
  Synthetic
  Optimized splice acceptor site
cagtttcttcctgtatagtagactcaccgtggataaatcaa

SEQ ID NO: 673 - DNA, 41 bp, Artificial Sequence
  Synthetic
  Optimized splice acceptor site
gggcaacgtgttcagctgcagcgtgatgcacgaggccctgc

SEQ ID NO: 674 - DNA, 41 bp, Artificial Sequence
  Synthetic
  Optimized splice acceptor site
cggagtgctggcctgttacagcctgctggttaccgtggcct

SEQ ID NO: 675 - DNA, 41 bp, Artificial Sequence
  Synthetic
  Optimized splice acceptor site
gctgagagtgaagttcagcagatccgccgacgctccagcct

SEQ ID NO: 676 - DNA, 41 bp, Artificial Sequence
  Synthetic
  Optimized splice acceptor site
acacctccactggatccccaagagctggatatcctgaaaac

SEQ ID NO: 677 - DNA, 41 bp, Artificial Sequence
  Synthetic
  Optimized splice acceptor site
accggattcctcctgatccaagcctggccagagaacagaac

SEQ ID NO: 678 - DNA, 41 bp, Artificial Sequence
  Synthetic
  Optimized splice acceptor site
acggccagtttagcctggctgtggtgtctctgaacatcacc

SEQ ID NO: 679 - DNA, 123 bp, Artificial Sequence
  Synthetic
  CD28 endo (nt)
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 680 - protein, 41 aa, Artificial Sequence
  Synthetic
  CD28 endo (aa)
RSKRSRLLHSDYMNMTPRRPGPTRKHYQPYAPPRDFAAYRS

SEQ ID NO: 681 - DNA, 126 bp, Artificial Sequence
  Synthetic
  4-1BB-derived intracellular co-signaling sequence (nt)
aagcggggcagaaagaagctgctctacatcttcaagcagcccttcatgcggcccgtgcagaccacacaagaggaagatggctgctcctgcagattccccgaggaagaagaaggcggctgcgagctg

SEQ ID NO: 682 - DNA, 60 bp, Homo sapiens
  human IgG -kappa signal sequence (nt)
atggtgctgcagacccaggtgttcatcagcctgctgctgtggatctctggcgcctacggc

SEQ ID NO: 683 - DNA, 60 bp, Homo sapiens
  human IgG -kappa signal sequence (nt)
atggtgctgcagacccaggtgttcatcagcctgctgctgtggatctctggcgcctatgga

SEQ ID NO: 684 - DNA, 60 bp, Homo sapiens
  human IgG -kappa signal sequence (nt)
atggtgctgcagacacaggtgttcatctccctgctgctgtggatctctggagcatacgga

SEQ ID NO: 685 - DNA, 60 bp, Homo sapiens
  human IgG -kappa signal sequence (nt)
atggtgctgcagacacaggtgttcatcagcctgctgctgtggatctccggagcatacgga

SEQ ID NO: 686 - DNA, 72 bp, Artificial Sequence
  Synthetic
  T2A peptide (nt)
ctcgagggcggcggagagggcagaggaagtcttctaacatgcggtgacgtggaggagaatcccggccctagg

SEQ ID NO: 687 - DNA, 72 bp, Artificial Sequence
  Synthetic
  T2A peptide (nt)
cttgaaggtggtggcgaaggcagaggcagcctgcttacatgcggagatgtggaagagaaccccggacctaga

SEQ ID NO: 688 - DNA, 84 bp, Artificial Sequence
  Synthetic
  CD28 transmembrane domain (nt)
atgttctgggtgctcgtggtcgttggcggagtgctggcctgttacagcctgctggttaccgtggccttcatcatcttttgggtc

SEQ ID NO: 689 - DNA, 15 bp, Artificial Sequence
  Synthetic
  Predicted splice donor site
cgtctaggtaagttt

SEQ ID NO: 690 - DNA, 15 bp, Artificial Sequence
  Synthetic
  Predicted splice donor site
gaccaaggtgaccgt

SEQ ID NO: 691 - DNA, 15 bp, Artificial Sequence
  Synthetic
  Predicted splice donor site
tgcactggtaccagc

SEQ ID NO: 692 - DNA, 15 bp, Artificial Sequence
  Synthetic
  Predicted splice donor site
taaactggtaccagc

SEQ ID NO: 693 - DNA, 15 bp, Artificial Sequence
  Synthetic
  Predicted splice donor site
atctcctgtaagggt

SEQ ID NO: 694 - DNA, 15 bp, Artificial Sequence
  Synthetic
  Predicted splice donor site
ggtcaaggtactctg

SEQ ID NO: 695 - DNA, 15 bp, Artificial Sequence
  Synthetic
  Predicted splice donor site
gaggacagtaagcgg

SEQ ID NO: 696 - DNA, 15 bp, Artificial Sequence
  Synthetic
  Predicted splice donor site
ggtcaaggtactctg

SEQ ID NO: 697 - DNA, 15 bp, Artificial Sequence
  Synthetic
  Predicted splice donor site
tgcctccgtgtctgc

SEQ ID NO: 698 - DNA, 15 bp, Artificial Sequence
  Synthetic
  Predicted splice donor site
caccaaggtgaccgt

SEQ ID NO: 699 - DNA, 15 bp, Artificial Sequence
  Synthetic
  Predicted splice donor site
tgaactggtatcagc

SEQ ID NO: 700 - DNA, 15 bp, Artificial Sequence
  Synthetic
  Predicted splice donor site
atctcttgaaatggt

SEQ ID NO: 701 - DNA, 15 bp, Artificial Sequence
  Synthetic
  Predicted splice donor site
ggccagggcacactg

SEQ ID NO: 702 - DNA, 15 bp, Artificial Sequence
  Synthetic
  Predicted splice donor site
gaggacagcaagagg

SEQ ID NO: 703 - DNA, 15 bp, Artificial Sequence
  Synthetic
  Predicted splice donor site
ggccagggaaccctg

SEQ ID NO: 704 - DNA, 15 bp, Artificial Sequence
  Synthetic
  Predicted splice donor site
tgccagcgttagtgc

SEQ ID NO: 705 - DNA, 15 bp, Artificial Sequence
  Synthetic
  Predicted splice donor site
aatctaagtacggac

SEQ ID NO: 706 - DNA, 15 bp, Artificial Sequence
  Synthetic
  Predicted splice donor site
tcaactggtacgtgg

SEQ ID NO: 707 - DNA, 15 bp, Artificial Sequence
  Synthetic
  Predicted splice donor site
acaattagtaaggca

SEQ ID NO: 708 - DNA, 15 bp, Artificial Sequence
  Synthetic
  Predicted splice donor site
accacaggtgtatac

SEQ ID NO: 709 - DNA, 15 bp, Artificial Sequence
  Synthetic
  Predicted splice donor site
tttccaggtccgccg

SEQ ID NO: 710 - DNA, 15 bp, Artificial Sequence
  Synthetic
  Predicted splice donor site
ctgctctgtgagtta

SEQ ID NO: 711 - DNA, 15 bp, Artificial Sequence
  Synthetic
  Predicted splice donor site
acgcaaagtgtgtaa

SEQ ID NO: 712 - DNA, 15 bp, Artificial Sequence
  Synthetic
  Predicted splice donor site
caacatggtcagttt

SEQ ID NO: 713 - DNA, 15 bp, Artificial Sequence
  Synthetic
  Predicted splice donor site
aacagaggtgaaaac

SEQ ID NO: 714 - DNA, 15 bp, Artificial Sequence
  Synthetic
  Predicted splice donor site
ctggagggtgagcca

SEQ ID NO: 715 - DNA, 729 bp, Artificial Sequence
  Synthetic
  BCMA-23 scFv (nt)
gaggtgcagctggtggagtccggaggaggcctggtgaagccaggaggctccctgaggctgtcttgcgcagccagcggcttcacctttagcgactactatatgtcctggatcagacaggcacctggcaagggcctggagtgggtgagctacatcagctcctctggctccacaatctactatgccgactctgtgaagggccggtttaccatcagcagagataacgccaagaattccctgtatctgcagatgaacagcctgagggccgaggacacagccgtgtactattgcgccaaggtggacggcgattacaccgaggattattggggccagggcacactggtgaccgtgagctccggcggcggcggctctggaggaggaggcagcggcggaggaggctcccagtctgccctgacacagccagccagcgtgtccggctctcccggacagtccatcacaatctcttgtaccggctctagctccgacgtgggcaagtacaacctggtgtcctggtatcagcagccccctggcaaggcccctaagctgatcatctacgatgtgaacaagaggccatctggcgtgagcaatcgcttcagcggctccaagtctggcaataccgccacactgaccatcagcggcctgcagggcgacgatgaggcagattactattgttctagctacggcggcagcagatcctacgtgttcggcacaggcaccaaggtgaccgtgctg

SEQ ID NO: 716 - DNA, 720 bp, Artificial Sequence
  Synthetic
  BCMA-25 scFV(nt)
gaggtgcagctggtgcagagcggaggaggcctggtgcagcctggcaggtccctgcgcctgtcttgcaccgccagcggcttcacatttggcgactatgccatgtcctggttcaggcaggcaccaggcaagggcctggagtgggtgggctttatccgctctaaggcctacggcggcaccacagagtatgccgccagcgtgaagggccggttcaccatcagccgggacgactctaagagcatcgcctacctgcagatgaactctctgaagaccgaggacacagccgtgtactattgcgcagcatggagcgccccaaccgattattggggccagggcaccctggtgacagtgagctccggcggcggcggctctggaggaggaggaagcggaggaggaggatccgacatccagatgacacagtcccctgcctttctgtccgcctctgtgggcgatagggtgaccgtgacatgtcgcgcctcccagggcatctctaactacctggcctggtatcagcagaagcccggcaatgcccctcggctgctgatctacagcgcctccaccctgcagagcggagtgccctcccggttcagaggaaccggctatggcacagagttttctctgaccatcgacagcctgcagccagaggatttcgccacatactattgtcagcagtcttacaccagccggcagacatttggccccggcacaagactggatatcaag

SEQ ID NO: 717 - DNA, 720 bp, Artificial Sequence
  Synthetic
  BCMA-25 scFV(nt) (O/SSE)
gaggtgcagctggtgcagagcggaggaggcctggtgcagcctggcaggtccctgcgcctgtcttgcaccgccagcggcttcacatttggcgactatgccatgtcctggttcaagcaggcaccaggcaagggcctggagtgggtgggctttatccgctctaaggcctacggcggcaccacagagtatgccgccagcgtgaagggccggttcaccatcagccgggacgactctaagagcatcgcctacctgcagatgaactctctgaagaccgaggacacagccgtgtactattgcgcagcatggagcgccccaaccgattattggggccagggcaccctggtgacagtgagctccggcggcggcggctctggaggaggaggaagcggaggaggaggatccgacatccagatgacacagtcccctgcctttctgtccgcctctgtgggcgatagggtgaccgtgacatgtcgcgcctcccagggcatctctaactacctggcctggtatcagcagaagcccggcaatgcccctcggctgctgatctacagcgcctccaccctgcagagcggagtgccctcccggttcagaggaaccggctatggcacagagttttctctgaccatcgacagcctgcagccagaggatttcgccacatactattgtcagcagtcttacaccagccggcagacatttggccccggcacaagactggatatcaag

SEQ ID NO: 718 - DNA, 723 bp, Artificial Sequence
  Synthetic
  BCMA-26 scFV(nt)
gaggtgcagctggtggagtccggaggaggcctggtgaagccaggaggctctctgaggctgagctgcgcagcctccggcttcaccttttctgactactatatgagctggatcaggcaggcaccaggcaagggcctggagtgggtgtcttacatcagctcctctggcagcacaatctactatgccgactccgtgaagggcaggttcaccatctctcgcgataacgccaagaatagcctgtatctgcagatgaactccctgcgggccgaggatacagccgtgtactattgcgccaaggtggacggccccccttcctttgatatctggggccagggcacaatggtgaccgtgagctccggaggaggaggatccggcggaggaggctctggcggcggcggctctagctatgtgctgacccagccaccatccgtgtctgtggcacctggacagacagcaaggatcacctgtggagcaaacaatatcggcagcaagtccgtgcactggtaccagcagaagcctggccaggccccaatgctggtggtgtatgacgatgacgatcggcccagcggcatccctgagagattttctggcagcaactccggcaataccgccacactgaccatctctggagtggaggcaggcgacgaggcagattacttctgtcacctgtgggaccggagcagagatcactacgtgttcggcacaggcaccaagctgaccgtgctg

SEQ ID NO: 719 - DNA, 723 bp, Artificial Sequence; identical to SEQ ID NO: 718
  Synthetic
  BCMA-26 scFV(nt) (O/SSE)

SEQ ID NO: 720 - DNA, 15 bp, Artificial Sequence
  Synthetic
  truncated marker predicted splice donor site
tcttcatgtgagcgg

SEQ ID NO: 721 - DNA, 41 bp, Artificial Sequence
  Synthetic
  promoter predicted splice acceptor site
tggctccgcctttttcccgagggtgggggagaaccgtatat

SEQ ID NO: 722 - DNA, 41 bp, Artificial Sequence
  Synthetic
  promoter predicted splice acceptor site
tgaactgcgtccgccgtctaggtaagtttaaagctcaggtc

SEQ ID NO: 723 - DNA, 41 bp, Artificial Sequence
  Synthetic
  promoter predicted splice acceptor site
ttctgttctgcgccgttacagatccaagctgtgaccggcgc

SEQ ID NO: 724 - DNA, 41 bp, Artificial Sequence
  Synthetic
  BCMA-23 predicted splice acceptor site
ctactacatgagctggatccgccaggctccagggaaggggc

SEQ ID NO: 725 - DNA, 41 bp, Artificial Sequence
  Synthetic
  BCMA-23 predicted splice acceptor site
ggctgattattattgtagctcatatggaggtagtaggtctt

SEQ ID NO: 726 - DNA, 41 bp, Artificial Sequence
  Synthetic
  BCMA-25 predicted splice acceptor site
ctatgccatgtcctggttcaggcaggcaccaggcaagggcc

SEQ ID NO: 727 - DNA, 41 bp, Artificial Sequence
  Synthetic
  BCMA-25 predicted splice acceptor site
gtccgcctctgtgggcgatagggtgaccgtgacatgtcgcg

SEQ ID NO: 728 - DNA, 41 bp, Artificial Sequence
  Synthetic
  BCMA-25 predicted splice acceptor site
gtgggctttatccgctctaaggcctacggcggcaccacaga

SEQ ID NO: 729 - DNA, 41 bp, Artificial Sequence
  Synthetic
  BCMA-25 predicted splice acceptor site
gtgacatgtcgcgcctcccagggcatctctaactacctggc

SEQ ID NO: 730 - DNA, 41 bp, Artificial Sequence
  Synthetic
  BCMA-25 predicted splice acceptor site
tacagcgcctccaccctgcagagcggagtgccctcccggtt

SEQ ID NO: 731 - DNA, 41 bp, Artificial Sequence
  Synthetic
  BCMA-52 predicted splice acceptor site
ctggccatcagtggcctccagtctgaggatgaggctgatta

SEQ ID NO: 732 - DNA, 41 bp, Artificial Sequence
  Synthetic
  BCMA-52 predicted splice acceptor site
agatacagcccgtccttccaaggccacgtcaccatctcagc

SEQ ID NO: 733 - DNA, 41 bp, Artificial Sequence
  Synthetic
  BCMA-55 predicted splice acceptor site
cgaggctgattattactgcagctcaaatacaagaagcagca

SEQ ID NO: 734 - DNA, 41 bp, Artificial Sequence
  Synthetic
  BCMA-55 predicted splice acceptor site
gccctcaggggtttctaatcgcttctctggctccaagtctg

SEQ ID NO: 735 - DNA, 41 bp, Artificial Sequence
  Synthetic
  BCMA-23 predicted splice acceptor site (O/SSE)
ctactatatgtcctggatcagacaggcacctggcaagggcc

SEQ ID NO: 736 - DNA, 41 bp, Artificial Sequence
  Synthetic
  BCMA-23 predicted splice acceptor site (O/SSE)
ggcagattactattgttctagctacggcggcagcagatcct

SEQ ID NO: 737 - DNA, 41 bp, Artificial Sequence
  Synthetic
  BCMA-25 predicted splice acceptor site (O/SSE)
ctatgccatgtcctggttcaagcaggcaccaggcaagggcc

SEQ ID NO: 738 - DNA, 41 bp, Artificial Sequence
  Synthetic
  BCMA-52 predicted splice acceptor site (O/SSE)
ctggctatttctggactgcagagcgaggacgaggccgacta

SEQ ID NO: 739 - DNA, 41 bp, Artificial Sequence
  Synthetic
  BCMA-52 predicted splice acceptor site (O/SSE)
agatacagccctagctttcagggccacgtgaccatcagcgc

SEQ ID NO: 740 - DNA, 41 bp, Artificial Sequence
  Synthetic
  BCMA-55 predicted splice acceptor site (O/SSE)
cgaggccgattactactgcagcagcaacacccggtccagca

SEQ ID NO: 741 - DNA, 41 bp, Artificial Sequence
  Synthetic
  BCMA-55 predicted splice acceptor site (O/SSE)
gcccagcggcgtgtccaatagattcagcggcagcaagagcg

SEQ ID NO: 742 - DNA, 41 bp, Artificial Sequence
  Synthetic
  spacer predicted splice acceptor site
aagtttctttctgtattccaggctgaccgtggataaatctc

SEQ ID NO: 743 - DNA, 41 bp, Artificial Sequence
  Synthetic
  spacer predicted splice acceptor site
gggcaacgtgttctcttgcagtgtcatgcacgaagccctgc

SEQ ID NO: 744 - DNA, 41 bp, Artificial Sequence
  Synthetic
  CD28TM predicted splice acceptor site
aggggtgctggcctgttacagcctgctggtgacagtcgctt

SEQ ID NO: 745 - DNA, 41 bp, Artificial Sequence
  Synthetic
  4-1BB/CD3 zeta predicted splice acceptor site
gctgagagtcaagttttccaggtccgccgacgctccagcct

SEQ ID NO: 746 - DNA, 41 bp, Artificial Sequence
  Synthetic
  truncated marker predicted splice acceptor site
actcctcctctggatccacaggaactggatattctgaaaac

SEQ ID NO: 747 - DNA, 41 bp, Artificial Sequence
  Synthetic
  truncated marker predicted splice acceptor site
acagggtttttgctgattcaggcttggcctgaaaacaggac

SEQ ID NO: 748 - DNA, 41 bp, Artificial Sequence
  Synthetic
  truncated marker predicted splice acceptor site
atggtcagttttctcttgcagtcgtcagcctgaacataaca

SEQ ID NO: 749 - protein, 326 aa, Homo sapiens
  Human IgG2 Fc (Uniprot P01859)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 750 - protein, 327 aa, Homo sapiens
  Human IgG4 Fc (Uniprot P01861)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 751 - DNA, 1959 bp, Artificial Sequence
  Synthetic
  anti-BMCA CAR
gaggtgcagctggtggagtccggaggaggcctggtgaagccaggaggctccctgaggctgtcttgcgcagccagcggcttcacctttagcgactactatatgtcctggatcagacaggcacctggcaagggcctggagtgggtgagctacatcagctcctctggctccacaatctactatgccgactctgtgaagggccggtttaccatcagcagagataacgccaagaattccctgtatctgcagatgaacagcctgagggccgaggacacagccgtgtactattgcgccaaggtggacggcgattacaccgaggattattggggccagggcacactggtgaccgtgagctccggcggcggcggctctggaggaggaggcagcggcggaggaggctcccagtctgccctgacacagccagccagcgtgtccggctctcccggacagtccatcacaatctcttgtaccggctctagctccgacgtgggcaagtacaacctggtgtcctggtatcagcagccccctggcaaggcccctaagctgatcatctacgatgtgaacaagaggccatctggcgtgagcaatcgcttcagcggctccaagtctggcaataccgccacactgaccatcagcggcctgcagggcgacgatgaggcagattactattgttctagctacggcggcagcagatcctacgtgttcggcacaggcaccaaggtgaccgtgctggaatctaagtacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaagatgttctgggtgctcgtggtcgttggcggagtgctggcctgttacagcctgctggttaccgtggccttcatcatcttttgggtcaagcggggcagaaagaagctgctctacatcttcaagcagcccttcatgcggcccgtgcagaccacacaagaggaagatggctgctcctgcagattccccgaggaagaagaaggcggctgcgagctgagagtgaagttcagcagatccgccgacgctccagcctatcagcagggccaaaaccagctgtacaacgagctgaacctggggagaagagaagagtacgacgtgctggataagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggcctgagcaccgccaccaaggatacctatgacgcactgcacatgcaggccctgccacctaga

SEQ ID NO: 752 - DNA, 1950 bp, Artificial Sequence
  Synthetic
  anti-BMCA CAR
gaggtgcagctggtgcagagcggaggaggcctggtgcagcctggcaggtccctgcgcctgtcttgcaccgccagcggcttcacatttggcgactatgccatgtcctggttcaagcaggcaccaggcaagggcctggagtgggtgggctttatccgctctaaggcctacggcggcaccacagagtatgccgccagcgtgaagggccggttcaccatcagccgggacgactctaagagcatcgcctacctgcagatgaactctctgaagaccgaggacacagccgtgtactattgcgcagcatggagcgccccaaccgattattggggccagggcaccctggtgacagtgagctccggcggcggcggctctggaggaggaggaagcggaggaggaggatccgacatccagatgacacagtcccctgcctttctgtccgcctctgtgggcgatagggtgaccgtgacatgtcgcgcctcccagggcatctctaactacctggcctggtatcagcagaagcccggcaatgcccctcggctgctgatctacagcgcctccaccctgcagagcggagtgccctcccggttcagaggaaccggctatggcacagagttttctctgaccatcgacagcctgcagccagaggatttcgccacatactattgtcagcagtcttacaccagccggcagacatttggccccggcacaagactggatatcaaggagtctaaatacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaagatgttctgggtgctcgtggtcgttggcggagtgctggcctgttacagcctgctggttaccgtggccttcatcatcttttgggtcaagcggggcagaaagaagctgctctacatcttcaagcagcccttcatgcggcccgtgcagaccacacaagaggaagatggctgctcctgcagattccccgaggaagaagaaggcggctgcgagctgagagtgaagttcagcagatccgccgacgctccagcctatcagcagggccaaaaccagctgtacaacgagctgaacctggggagaagagaagagtacgacgtgctggataagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggcctgagcaccgccaccaaggatacctatgacgcactgcacatgcaggccctgccacctaga

SEQ ID NO: 753 - DNA, 1953 bp, Artificial Sequence
  Synthetic
  anti-BMCA CAR
gaggtgcagctggtggagtccggaggaggcctggtgaagccaggaggctctctgaggctgagctgcgcagcctccggcttcaccttttctgactactatatgagctggatcaggcaggcaccaggcaagggcctggagtgggtgtcttacatcagctcctctggcagcacaatctactatgccgactccgtgaagggcaggttcaccatctctcgcgataacgccaagaatagcctgtatctgcagatgaactccctgcgggccgaggatacagccgtgtactattgcgccaaggtggacggccccccttcctttgatatctggggccagggcacaatggtgaccgtgagctccggaggaggaggatccggcggaggaggctctggcggcggcggctctagctatgtgctgacccagccaccatccgtgtctgtggcacctggacagacagcaaggatcacctgtggagcaaacaatatcggcagcaagtccgtgcactggtaccagcagaagcctggccaggccccaatgctggtggtgtatgacgatgacgatcggcccagcggcatccctgagagattttctggcagcaactccggcaataccgccacactgaccatctctggagtggaggcaggcgacgaggcagattacttctgtcacctgtgggaccggagcagagatcactacgtgttcggcacaggcaccaagctgaccgtgctggaatctaagtacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaagatgttctgggtgctcgtggtcgttggcggagtgctggcctgttacagcctgctggttaccgtggccttcatcatcttttgggtcaagcggggcagaaagaagctgctctacatcttcaagcagcccttcatgcggcccgtgcagaccacacaagaggaagatggctgctcctgcagattccccgaggaagaagaaggcggctgcgagctgagagtgaagttcagcagatccgccgacgctccagcctatcagcagggccaaaaccagctgtacaacgagctgaacctggggagaagagaagagtacgacgtgctggataagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggcctgagcaccgccaccaaggatacctatgacgcactgcacatgcaggccctgccacctaga

SEQ ID NO: 754 - DNA, 1974 bp, Artificial Sequence
  Synthetic
  anti-BMCA CAR
agctatgagctgacacagcctccaagcgcctctggcacacctggacagcgagtgacaatgagctgtagcggcaccagcagcaacatcggcagccacagcgtgaactggtatcagcagctgcctggcacagcccctaaactgctgatctacaccaacaaccagcggcctagcggcgtgcccgatagattttctggcagcaagagcggcacaagcgccagcctggctatttctggactgcagagcgaggacgaggccgactattattgtgccgcctgggacggctctctgaacggccttgtttttggcggaggcaccaagctgacagtgctgggatctagaggtggcggaggatctggcggcggaggaagcggaggcggcggatctcttgaaatggctgaagtgcagctggtgcagtctggcgccgaagtgaagaagcctggcgagagcctgaagatcagctgcaaaggcagcggctacagcttcaccagctactggatcggctgggtccgacagatgcctggcaaaggccttgagtggatgggcatcatctaccccggcgacagcgacaccagatacagccctagctttcagggccacgtgaccatcagcgccgacaagtctatcagcaccgcctacctgcagtggtccagcctgaaggcctctgacaccgccatgtactactgcgccagatactctggcagcttcgacaattggggccagggcacactggtcaccgtgtccagcgagtctaaatacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaagatgttctgggtgctcgtggtcgttggcggagtgctggcctgttacagcctgctggttaccgtggccttcatcatcttttgggtcaagcggggcagaaagaagctgctctacatcttcaagcagcccttcatgcggcccgtgcagaccacacaagaggaagatggctgctcctgcagattccccgaggaagaagaaggcggctgcgagctgagagtgaagttcagcagatccgccgacgctccagcctatcagcagggccaaaaccagctgtacaacgagctgaacctggggagaagagaagagtacgacgtgctggataagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggcctgagcaccgccaccaaggatacctatgacgcactgcacatgcaggccctgccacctaga

SEQ ID NO: 755 - DNA, 1962 bp, Artificial Sequence
  Synthetic
  anti-BMCA CAR
cagtctgccctgacacagcctgccagcgttagtgctagtcccggacagtctatcgccatcagctgtaccggcaccagctctgacgttggctggtatcagcagcaccctggcaaggcccctaagctgatgatctacgaggacagcaagaggcccagcggcgtgtccaatagattcagcggcagcaagagcggcaacaccgccagcctgacaattagcggactgcaggccgaggacgaggccgattactactgcagcagcaacacccggtccagcacactggtttttggcggaggcaccaagctgacagtgctgggatctagaggtggcggaggatctggcggcggaggaagcggaggcggcggatctcttgaaatggctgaagtgcagctggtgcagtctggcgccgagatgaagaaacctggcgcctctctgaagctgagctgcaaggccagcggctacaccttcatcgactactacgtgtactggatgcggcaggcccctggacagggactcgaatctatgggctggatcaaccccaatagcggcggcaccaattacgcccagaaattccagggcagagtgaccatgaccagagacaccagcatcagcaccgcctacatggaactgagccggctgagatccgacgacaccgccatgtactactgcgccagatctcagcgcgacggctacatggattattggggccagggaaccctggtcaccgtgtccagcgagtctaaatacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaagatgttctgggtgctcgtggtcgttggcggagtgctggcctgttacagcctgctggttaccgtggccttcatcatcttttgggtcaagcggggcagaaagaagctgctctacatcttcaagcagcccttcatgcggcccgtgcagaccacacaagaggaagatggctgctcctgcagattccccgaggaagaagaaggcggctgcgagctgagagtgaagttcagcagatccgccgacgctccagcctatcagcagggccaaaaccagctgtacaacgagctgaacctggggagaagagaagagtacgacgtgctggataagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggcctgagcaccgccaccaaggatacctatgacgcactgcacatgcaggccctgccacctaga

SEQ ID NO: 756 - DNA, 1959 bp, Artificial Sequence
  Synthetic
  anti-BMCA CAR
cagtctgccctgacacagcctgccagcgttagtgctagtcccggacagtctatcgccatcagctgtaccggcaccagctctgacgttggctggtatcagcagcaccctggcaaggcccctaagctgatgatctacgaggacagcaagaggcccagcggcgtgtccaatagattcagcggcagcaagagcggcaacaccgccagcctgacaattagcggactgcaggccgaggacgaggccgattactactgcagcagcaacacccggtccagcacactggtttttggcggaggcaccaagctgacagtgctgggatctagaggtggcggaggatctggcggcggaggaagcggaggcggcggatctcttgaaatggctgaagtgcagctggtgcagtctggcgccgagatgaagaaacctggcgcctctctgaagctgagctgcaaggccagcggctacaccttcatcgactactacgtgtactggatgcggcaggcccctggacagggactcgaatctatgggctggatcaaccccaatagcggcggcaccaattacgcccagaaattccagggcagagtgaccatgaccagagacaccagcatcagcaccgcctacatggaactgagccggctgagatccgacgacaccgccatgtactactgcgccagatctcagcgcgacggctacatggattattggggccagggaaccctggtcaccgtgtccagcgagtctaaatacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaagatgttctgggtgctcgtggtcgttggcggagtgctggcctgttacagcctgctggttaccgtggccttcatcatcttttgggtcaggagtaagaggagcaggctcctgcacagtgactacatgaacatgactccccgccgccccgggcccacccgcaagcattaccagccctatgccccaccacgcgacttcgcagcctatcgctccagagtgaagttcagcagatccgccgacgctccagcctatcagcagggccaaaaccagctgtacaacgagctgaacctggggagaagagaagagtacgacgtgctggataagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggcctgagcaccgccaccaaggatacctatgacgcactgcacatgcaggccctgccacctaga

SEQ ID NO: 757 - protein, 653 aa, Artificial Sequence
  Synthetic
  anti-BMCA CAR
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGDYTEDYWGQGTLVTVSSGGGGSGGGGSGGGGSQSALTQPASVSGSPGQSITISCTGSSSDVGKYNLVSWYQQPPGKAPKLIIYDVNKRPSGVSNRFSGSKSGNTATLTISGLQGDDEADYYCSSYGGSRSYVFGTGTKVTVLESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 758 - protein, 650 aa, Artificial Sequence
  Synthetic
  anti-BMCA CAR
EVQLVQSGGGLVQPGRSLRLSCTASGFTFGDYAMSWFKQAPGKGLEWVGFIRSKAYGGTTEYAASVKGRFTISRDDSKSIAYLQMNSLKTEDTAVYYCAAWSAPTDYWGQGTLVTVSSGGGGSGGGGSGGGGSDIQMTQSPAFLSASVGDRVTVTCRASQGISNYLAWYQQKPGNAPRLLIYSASTLQSGVPSRFRGTGYGTEFSLTIDSLQPEDFATYYCQQSYTSRQTFGPGTRLDIKESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 759 - protein, 651 aa, Artificial Sequence
  Synthetic
  anti-BMCA CAR
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAKVDGPPSFDIWGQGTMVTVSSGGGGSGGGGSGGGGSSYVLTQPPSVSVAPGQTARITCGANNIGSKSVHWYQQKPGQAPMLVVYDDDDRPSGIPERFSGSNSGNTATLTISGVEAGDEADYFCHLWDRSRDHYVFGTGTKLTVLESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 760 - protein, 658 aa, Artificial Sequence
  Synthetic
  anti-BMCA CAR
SYELTQPPSASGTPGQRVTMSCSGTSSNIGSHSVNWYQQLPGTAPKLLIYTNNQRPSGVPDRFSGSKSGTSASLAISGLQSEDEADYYCAAWDGSLNGLVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGHVTISADKSISTAYLQWSSLKASDTAMYYCARYSGSFDNWGQGTLVTVSSESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 761 - protein, 654 aa, Artificial Sequence
  Synthetic
  anti-BMCA CAR
QSALTQPASVSASPGQSIAISCTGTSSDVGWYQQHPGKAPKLMIYEDSKRPSGVSNRFSGSKSGNTASLTISGLQAEDEADYYCSSNTRSSTLVFGGGTKLTVLGSRGGGGSGGGGSGGGGSLEMAEVQLVQSGAEMKKPGASLKLSCKASGYTFIDYYVYWMRQAPGQGLESMGWINPNSGGTNYAQKFQGRVTMTRDTSISTAYMELSRLRSDDTAMYYCARSQRDGYMDYWGQGTLVTVSSESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 762 - protein, 653 aa, Artificial Sequence
  Synthetic
  anti-BMCA CAR
QSALTQPASVSASPGQSIAISCTGTSSDVGWYQQHPGKAPKLMIYEDSKRPSGVSNRFSGSKSGNTASLTISGLQAEDEADYYCSSNTRSSTLVFGGGTKLTVLGSRGGGGSGGGGSGGGGSLEMAEVQLVQSGAEMKKPGASLKLSCKASGYTFIDYYVYWMRQAPGQGLESMGWINPNSGGTNYAQKFQGRVTMTRDTSISTAYMELSRLRSDDTAMYYCARSQRDGYMDYWGQGTLVTVSSESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 763 - DNA, 20 bp, Artificial Sequence
  Synthetic
  EF1a/HTLV promoter forward primer
ctttttcgcaacgggtttgc

SEQ ID NO: 764 - DNA, 20 bp, Artificial Sequence
  Synthetic
  Reverse primer just 5? of WPRE
gatatcgaattcctgcagcc

SEQ ID NO: 765 - DNA, 41 bp, Artificial Sequence
  Synthetic
  predicted splice acceptor site
cgccttgtcctccttgtccagctcctcctgttgccggacct

SEQ ID NO: 766 - DNA, 41 bp, Artificial Sequence
  Synthetic
  optimized splice acceptor site
cgccttgtcctccttgtcccgctcctcctgttgccggacct

SEQ ID NO: 767 - DNA, 41 bp, Artificial Sequence; identical to SEQ ID NO: 672
  Synthetic
  predicted splice acceptor site

SEQ ID NO: 768 - DNA, 41 bp, Artificial Sequence
  Synthetic
  predicted splice acceptor site
accggattcctcctgattcaggcctggccagagaacagaac

SEQ ID NO: 769 - protein, 254 aa, Artificial Sequence
  Synthetic
  anti-BMCA scFv
LPVLTQPPSTSGTPGQRVTVSCSGSSSNIGSNVVFWYQQLPGTAPKLVIYRNNQRPSGVPDRFSVSKSGTSASLAISGLRSEDEADYYCAAWDDSLSGYVFGTGTKVTVLGSRGGGGSGGGGSGGGGSLEMAEVQLVQSGAEVKKPGSSVKVSCKASGGTFSSYAISWVRQAPGQGLEWMGRIIPILGIANYAQKFQGRVTMTEDTSTDTAYMELSSLRSEDTAVYYCARSGYSKSIVSYMDYWGQGTLVTVSS

SEQ ID NO: 770 - protein, 253 aa, Artificial Sequence
  Synthetic
  anti-BCMA scFV
QAVLTQPPSASGTPGQRVTISCSGSSSNIGSNYVFWYQQLPGTAPKLLIYSNNQRPSGVPDRFSGSKSGTSASLAISGLRSEDEADYYCAAWDDSLSASYVFGTGTKVTVLGSRGGGGSGGGGSGGGGSLEMAQVQLVQSGAEVKKPGSSVKVSCKASGGTFSSYAISWVRQAPGQGLEWMGRIIPILGTANYAQKFQGRVTITADESTSTAYMELSSLRSEDTAVYYCARSGYGSYRWEDSWGQGTLVTVSS

SEQ ID NO: 771 - protein, 251 aa, Artificial Sequence
  Synthetic
  anti-BCMA scFV
QSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSS

SEQ ID NO: 772 - protein, 122 aa, Artificial Sequence
  Synthetic
  anti-BMCA VH
EVQLVQSGAEVKKPGSSVKVSCKASGGTFSSYAISWVRQAPGQGLEWMGRIIPILGIANYAQKFQGRVTMTEDTSTDTAYMELSSLRSEDTAVYYCARSGYSKSIVSYMDYWGQGTLVTVSS

SEQ ID NO: 773 - protein, 120 aa, Artificial Sequence
  Synthetic
  anti-BMCA VH
QVQLVQSGAEVKKPGSSVKVSCKASGGTFSSYAISWVRQAPGQGLEWMGRIIPILGTANYAQKFQGRVTITADESTSTAYMELSSLRSEDTAVYYCARSGYGSYRWEDSWGQGTLVTVSS

SEQ ID NO: 774 - protein, 118 aa, Artificial Sequence
  Synthetic
  anti-BMCA VH
QVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSS

SEQ ID NO: 775 - protein, 111 aa, Artificial Sequence
  Synthetic
  anti-BCMA VL
LPVLTQPPSTSGTPGQRVTVSCSGSSSNIGSNVVFWYQQLPGTAPKLVIYRNNQRPSGVPDRFSVSKSGTSASLAISGLRSEDEADYYCAAWDDSLSGYVFGTGTKVTVLG

SEQ ID NO: 776 - protein, 112 aa, Artificial Sequence
  Synthetic
  anti-BMCA VL
QAVLTQPPSASGTPGQRVTISCSGSSSNIGSNYVFWYQQLPGTAPKLLIYSNNQRPSGVPDRFSGSKSGTSASLAISGLRSEDEADYYCAAWDDSLSASYVFGTGTKVTVLG

SEQ ID NO: 777 - protein, 112 aa, Artificial Sequence
  Synthetic
  anti-BMCA VL
QSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLG

SEQ ID NO: 778 - protein, 21 aa, Artificial Sequence
  Synthetic
  linker
SRGGGGSGGGGSGGGGSLEMA

SEQ ID NO: 779 - protein, 5 aa, Artificial Sequence
  Synthetic
  BCMA epitope
YFDSL

SEQ ID NO: 780 - protein, 9 aa, Artificial Sequence
  Synthetic
  QNEYFDSLL
QNEYFDSLL

SEQ ID NO: 781 - protein, 254 aa, Artificial Sequence
  Synthetic
  anti-BCMA scFv
LPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSS

SEQ ID NO: 782 - protein, 243 aa, Artificial Sequence
  Synthetic
  anti-BCMA scFv
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSGSTSGSGKPGSGEGSTKGEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIK

SEQ ID NO: 783 - protein, 244 aa, Artificial Sequence
  Synthetic
  anti-BCMA scFv
EIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKRGSTSGSGKPGSGEGSTKGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSS

SEQ ID NO: 784 - protein, 252 aa, Artificial Sequence
  Synthetic
  anti-BCMA scFv
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSGSTSGSGKPGSGEGSTKGDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIK

SEQ ID NO: 785 - protein, 253 aa, Artificial Sequence
  Synthetic
  anti-BCMA scFv
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGSTSGSGKPGSGEGSTKGQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSS

SEQ ID NO: 786 - protein, 240 aa, Artificial Sequence
  Synthetic
  anti-BCMA scFv
QVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSGSTSGSGKPGSGEGSTKGEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIK

SEQ ID NO: 787 - protein, 241 aa, Artificial Sequence
  Synthetic
  anti-BCMA scFv
EIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGSTSGSGKPGSGEGSTKGQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSS

SEQ ID NO: 788 - protein, 247 aa, Artificial Sequence
  Synthetic
  anti-BCMA scFv
QLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSGSTSGSGKPGSGEGSTKGEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIK

SEQ ID NO: 789 - protein, 248 aa, Artificial Sequence
  Synthetic
  anti-BCMA scFv
EIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGSTSGSGKPGSGEGSTKGQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSS

SEQ ID NO: 790 - protein, 244 aa, Artificial Sequence
  Synthetic
  anti-BCMA scFv
EVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSGSTSGSGKPGSGEGSTKGEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIK

SEQ ID NO: 791 - protein, 245 aa, Artificial Sequence
  Synthetic
  anti-BCMA scFv
EIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGSTSGSGKPGSGEGSTKGEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSS

SEQ ID NO: 792 - protein, 247 aa, Artificial Sequence
  Synthetic
  anti-BCMA scFv
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARTDFWSGSPPGLDYWGQGTLVTVSSGSTSGSGKPGSGEGSTKGDIQLTQSPSSVSASVGDRVTITCRASQGISSWLAWYQQKPGKAPKLLIYGASSLQSGVPSRFSGSGSGTDFTLTISSLQPEDFATYYCQQIYTFPFTFGGGTKVEIK

SEQ ID NO: 793 - protein, 248 aa, Artificial Sequence
  Synthetic
  anti-BCMA scFv
DIQLTQSPSSVSASVGDRVTITCRASQGISSWLAWYQQKPGKAPKLLIYGASSLQSGVPSRFSGSGSGTDFTLTISSLQPEDFATYYCQQIYTFPFTFGGGTKVEIKRGSTSGSGKPGSGEGSTKGQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARTDFWSGSPPGLDYWGQGTLVTVSS

SEQ ID NO: 794 - protein, 257 aa, Artificial Sequence
  Synthetic
  anti-BCMA scFv
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSGSTSGSGKPGSGEGSTKGDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIK

SEQ ID NO: 795 - protein, 258 aa, Artificial Sequence
  Synthetic
  anti-BCMA scFv
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGSTSGSGKPGSGEGSTKGQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSS

SEQ ID NO: 796 - protein, 248 aa, Artificial Sequence
  Synthetic
  anti-BCMA scFv
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSGSTSGSGKPGSGEGSTKGEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIK

SEQ ID NO: 797 - protein, 249 aa, Artificial Sequence
  Synthetic
  anti-BCMA scFv
EIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGSTSGSGKPGSGEGSTKGQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSS

SEQ ID NO: 798 - protein, 246 aa, Artificial Sequence
  Synthetic
  anti-BCMA scFv
DIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSS

SEQ ID NO: 799 - protein, 246 aa, Artificial Sequence; identical to SEQ ID NO: 798
  Synthetic
  anti-BCMA scFv

SEQ ID NO: 800 - protein, 246 aa, Artificial Sequence; identical to SEQ ID NO: 798
  Synthetic
  anti-BCMA scFv

SEQ ID NO: 801 - protein, 239 aa, Artificial Sequence
  Synthetic
  anti-BCMA scFv
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 802 - protein, 246 aa, Artificial Sequence
  Synthetic
  anti-BCMA scFv
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 803 - protein, 239 aa, Artificial Sequence
  Synthetic
  anti-BCMA scFv
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 804 - protein, 241 aa, Artificial Sequence
  Synthetic
  anti-BCMA scFv
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 805 - protein, 243 aa, Artificial Sequence
  Synthetic
  anti-BCMA scFv
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSDIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 806 - protein, 243 aa, Artificial Sequence
  Synthetic
  anti-BCMA scFv
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 807 - protein, 243 aa, Artificial Sequence
  Synthetic
  anti-BCMA scFv
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 808 - protein, 246 aa, Artificial Sequence
  Synthetic
  anti-BCMA scFv
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIK

SEQ ID NO: 809 - protein, 246 aa, Artificial Sequence; identical to SEQ ID NO: 808
  Synthetic
  anti-BCMA scFv

SEQ ID NO: 810 - protein, 246 aa, Artificial Sequence; identical to SEQ ID NO: 808
  Synthetic
  anti-BCMA scFv

SEQ ID NO: 811 - protein, 246 aa, Artificial Sequence
  Synthetic
  anti-BCMA scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIK

SEQ ID NO: 812 - protein, 246 aa, Artificial Sequence; identical to SEQ ID NO: 811
  Synthetic
  anti-BCMA scFv

SEQ ID NO: 813 - protein, 246 aa, Artificial Sequence; identical to SEQ ID NO: 811
  Synthetic
  anti-BCMA scFv

SEQ ID NO: 814 - protein, 122 aa, Artificial Sequence
  Synthetic
  anti-BCMA VH
QVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 815 - protein, 121 aa, Artificial Sequence
  Synthetic
  anti-BMCA VH
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSS

SEQ ID NO: 816 - protein, 118 aa, Artificial Sequence
  Synthetic
  anti-BMCA VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSS

SEQ ID NO: 817 - protein, 122 aa, Artificial Sequence
  Synthetic
  anti-BMCA VH
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSS

SEQ ID NO: 818 - protein, 116 aa, Artificial Sequence
  Synthetic
  anti-BMCA VH
QVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSS

SEQ ID NO: 819 - protein, 122 aa, Artificial Sequence
  Synthetic
  anti-BMCA VH
QLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSS

SEQ ID NO: 820 - protein, 119 aa, Artificial Sequence
  Synthetic
  anti-BMCA VH
EVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSS

SEQ ID NO: 821 - protein, 122 aa, Artificial Sequence
  Synthetic
  anti-BMCA VH
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARTDFWSGSPPGLDYWGQGTLVTVSS

SEQ ID NO: 822 - protein, 126 aa, Artificial Sequence
  Synthetic
  anti-BMCA VH
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSS

SEQ ID NO: 823 - protein, 123 aa, Artificial Sequence
  Synthetic
  anti-BMCA VH
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSS

SEQ ID NO: 824 - protein, 117 aa, Artificial Sequence
  Synthetic
  anti-BMCA VH
QVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSS

SEQ ID NO: 825 - protein, 115 aa, Artificial Sequence
  Synthetic
  anti-BMCA VH
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 826 - protein, 120 aa, Artificial Sequence
  Synthetic
  anti-BMCA VH
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 827 - protein, 115 aa, Artificial Sequence
  Synthetic
  anti-BMCA VH
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 828 - protein, 115 aa, Artificial Sequence; identical to SEQ ID NO: 825
  Synthetic
  anti-BMCA VH

SEQ ID NO: 829 - protein, 117 aa, Artificial Sequence
  Synthetic
  anti-BMCA VH
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 830 - protein, 117 aa, Artificial Sequence
  Synthetic
  anti-BMCA VH
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 831 - protein, 119 aa, Artificial Sequence
  Synthetic
  anti-BMCA VH
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSS

SEQ ID NO: 832 - protein, 119 aa, Artificial Sequence
  Synthetic
  anti-BMCA VH
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSS

SEQ ID NO: 833 - protein, 112 aa, Artificial Sequence
  Synthetic
  anti-BCMA VL
LPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLG

SEQ ID NO: 834 - protein, 107 aa, Artificial Sequence
  Synthetic
  anti-BCMA VL
EIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIK

SEQ ID NO: 835 - protein, 112 aa, Artificial Sequence
  Synthetic
  anti-BCMA VL
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIK

SEQ ID NO: 836 - protein, 106 aa, Artificial Sequence
  Synthetic
  anti-BCMA VL
EIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIK

SEQ ID NO: 837 - protein, 107 aa, Artificial Sequence
  Synthetic
  anti-BCMA VL
EIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIK

SEQ ID NO: 838 - protein, 107 aa, Artificial Sequence
  Synthetic
  anti-BCMA VL
EIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIK

SEQ ID NO: 839 - protein, 107 aa, Artificial Sequence
  Synthetic
  anti-BCMA VL
DIQLTQSPSSVSASVGDRVTITCRASQGISSWLAWYQQKPGKAPKLLIYGASSLQSGVPSRFSGSGSGTDFTLTISSLQPEDFATYYCQQIYTFPFTFGGGTKVEIK

SEQ ID NO: 840 - protein, 113 aa, Artificial Sequence
  Synthetic
  anti-BCMA VL
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIK

SEQ ID NO: 841 - protein, 107 aa, Artificial Sequence
  Synthetic
  anti-BCMA VL
EIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIK

SEQ ID NO: 842 - protein, 111 aa, Artificial Sequence
  Synthetic
  anti-BCMA VL
DIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIK

SEQ ID NO: 843 - protein, 107 aa, Artificial Sequence
  Synthetic
  anti-BCMA VL
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 844 - protein, 109 aa, Artificial Sequence
  Synthetic
  anti-BCMA VL
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 845 - protein, 107 aa, Artificial Sequence
  Synthetic
  anti-BCMA VL
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 846 - protein, 109 aa, Artificial Sequence
  Synthetic
  anti-BCMA VL
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 847 - protein, 111 aa, Artificial Sequence
  Synthetic
  anti-BCMA VL
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 848 - protein, 112 aa, Artificial Sequence
  Synthetic
  anti-BCMA VL
DIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIK

SEQ ID NO: 849 - protein, 112 aa, Artificial Sequence
  Synthetic
  anti-BCMA VL
DIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIK

SEQ ID NO: 850 - DNA, 66 bp, Artificial Sequence
  Synthetic
  GMCSFR alpha chain signal sequence
atgcttctcctggtgacaagccttctgctctgtgagttaccacacccagcattcctcctgatccca

SEQ ID NO: 851 - protein, 22 aa, Artificial Sequence
  Synthetic
  GMCSFR alpha chain signal peptide
MLLLVTSLLLCELPHPAFLLIP

SEQ ID NO: 852 - protein, 18 aa, Artificial Sequence
  Synthetic
  CD8 alpha signal peptide
MALPVTALLLPLALLLHA

SEQ ID NO: 853 - protein, 16 aa, Artificial Sequence
  Synthetic
  CD33 signal peptide
MPLLLLLPLLWAGALA

SEQ ID NO: 854 - DNA, 41 bp, Artificial Sequence
  Synthetic
  Optimized splice acceptor site
aagtttctttctgtattccagactgaccgtggataaatctc

SEQ ID NO: 855 - DNA, 684 bp, Artificial Sequence
  Synthetic
  Spacer - codon optimized (nt)
gagtctaaatacggaccgccttgtcctccttgtccagctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaattggtacgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaaa

SEQ ID NO: 856 - DNA, 684 bp, Artificial Sequence
  Synthetic
  Alternative CO/SSE spacer (nt)
gaatctaagtacggaccgccttgtcctccttgtcccgctcctcctgttgccggaccttccgtgttcctgtttcctccaaagcctaaggacaccctgatgatcagcaggacccctgaagtgacctgcgtggtggtggatgtgtcccaagaggatcccgaggtgcagttcaactggtatgtggacggcgtggaagtgcacaacgccaagaccaagcctagagaggaacagttccagagcacctacagagtggtgtccgtgctgacagtgctgcaccaggattggctgaacggcaaagagtacaagtgcaaggtgtccaacaagggcctgcctagcagcatcgagaaaaccatctccaaggccaagggccagccaagagagccccaggtttacacactgcctccaagccaagaggaaatgaccaagaatcaggtgtccctgacatgcctggtcaagggcttctacccctccgatatcgccgtggaatgggagagcaatggccagcctgagaacaactacaagaccacacctcctgtgctggacagcgacggcagtttcttcctgtatagtagactcaccgtggataaatcaagatggcaagagggcaacgtgttcagctgcagcgtgatgcacgaggccctgcacaaccactacacccagaaaagcctgagcctgtctctgggcaag

What is claimed:

1. A polynucleotide encoding a chimeric antigen receptor, the polynucleotide comprising a nucleic acid sequence encoding: (a) an extracellular antigen-binding domain comprising a single-chain variable fragment (scFv) comprising a variable heavy chain ($V_H$) region and a variable light chain ($V_L$) region that specifically binds B cell maturation antigen (BCMA); (b) a spacer encoded by the nucleic acid sequence set forth in SEQ ID NO:622; (c) a transmembrane domain; and (d) an intracellular signaling region.

2. The polynucleotide of claim 1, wherein:
(A) the $V_H$ region comprises a CDR-H1, a CDR-H2 and a CDR-H3 contained within the $V_H$ region amino acid sequence set forth in SEQ ID NO:617; and the $V_L$ region comprises a CDR-L1, a CDR-L2 and a CDR-L3 contained within the $V_L$ region amino acid sequence set forth in SEQ ID NO:618;
(B) the $V_H$ region comprises a CDR-H1, a CDR-H2 and a CDR-H3 contained within the $V_H$ region amino acid sequence set forth in SEQ ID NO:609; and the $V_L$ region comprises a CDR-L1, a CDR-L2 and a CDR-L3 contained within the $V_L$ region amino acid sequence set forth in SEQ ID NO:610;
(C) the $V_H$ region comprises a CDR-H1, a CDR-H2 and a CDR-H3 contained within the $V_H$ region amino acid sequence set forth in SEQ ID NO:115; and the $V_L$ region comprises a CDR-LL a CDR-L2 and a CDR-L3 contained within the $V_L$ region amino acid sequence set forth in SEQ ID NO:536;
(D) the $V_H$ region comprises a CDR-H1, a CDR-H2 and a CDR-H3 contained within the $V_H$ region amino acid sequence set forth in SEQ ID NO:519; and the $V_L$ region comprises a CDR-L1, a CDR-L2 and a CDR-L3 contained within the $V_L$ region amino acid sequence set forth in SEQ ID NO:535; or
(E) the $V_H$ region comprises a CDR-H1, a CDR-H2 and a CDR-H3 contained within the $V_H$ region amino acid sequence set forth in SEQ ID NO:256; and the $V_L$ region comprises a CDR-L1, a CDR-L2 and a CDR-L3 contained within the $V_L$ region amino acid sequence set forth in SEQ ID NO:267.

3. The polynucleotide of claim 1, wherein the $V_H$ region comprises a CDR-H1, a CDR-H2 and a CDR-H3 contained within the $V_H$ region amino acid sequence set forth in SEQ ID NO:617; and the $V_L$ region comprises a CDR-LL a CDR-L2 and a CDR-L3 contained within the $V_L$ region amino acid sequence set forth in SEQ ID NO:618.

4. The polynucleotide of claim 1, wherein:
(A) the $V_H$ region and the $V_L$ region comprise the amino acid sequences set forth in SEQ ID NOs:617 and 618, respectively;
(B) the $V_H$ region and the $V_L$ region comprise the amino acid sequences set forth in SEQ ID NOs:609 and 610, respectively;
(C) the $V_H$ region and the $V_L$ region comprise the amino acid sequences set forth in SEQ ID NOs:115 and 536, respectively;
(D) the $V_H$ region and the $V_L$ region comprise the amino acid sequences set forth in SEQ ID NOs:519 and 535, respectively; or
(E) the $V_H$ region and the $V_L$ region comprise the amino acid sequences set forth in SEQ ID NOs:256 and 267, respectively.

5. The polynucleotide of claim 1, wherein the $V_H$ region and the $V_L$ region comprise the amino acid sequences set forth in SEQ ID NOs:617 and 618, respectively.

6. The polynucleotide of claim 1, wherein the scFv comprises the amino acid sequence set forth in SEQ ID NO:478, SEQ ID NO:442, SEQ ID NO:560, SEQ ID NO:559, or SEQ ID NO:278.

7. The polynucleotide of claim 1, wherein the scFv comprises the amino acid sequence set forth in SEQ ID NO:478.

8. The polynucleotide of claim 1, wherein the transmembrane domain is from a human CD28.

9. The polynucleotide of claim 1, wherein the intracellular signaling region comprises an activating cytoplasmic signaling domain that is or comprises a cytoplasmic signaling domain of a CD3-zeta (CD3ζ) chain.

10. The polynucleotide of claim 9, wherein the intracellular signaling region further comprises an intracellular signaling domain of a CD28, a 4-1BB, or an ICOS.

11. The polynucleotide of claim 9, wherein the intracellular signaling region further comprises an intracellular signaling domain of a 4-1BB.

12. The polynucleotide of claim 1, wherein the transmembrane domain is from a human CD28, and the intracellular signaling region comprises an activating cytoplasmic signaling domain that is or comprises a cytoplasmic signaling domain of a CD3-zeta (CD3ζ) chain and an intracellular signaling domain of a CD28 or a 4-1BB T cell costimulatory molecule.

13. The polynucleotide of claim 1, wherein the transmembrane domain is from a human CD28, and the intracellular signaling region comprises a cytoplasmic signaling domain of a CD3-zeta (CD3ζ) chain and an intracellular signaling domain of a 4-1BB T cell costimulatory molecule.

14. A vector comprising the polynucleotide of claim 1.

15. An engineered cell, comprising the polynucleotide of claim 1.

16. A T cell, comprising the polynucleotide of claim 1.

17. A composition comprising the engineered cell of claim 15.

18. A composition comprising the T cell of claim 16.

19. A chimeric antigen receptor encoded by the polynucleotide of claim 1.

20. An engineered cell, comprising the chimeric antigen receptor of claim 19.

21. A composition comprising the engineered cell of claim 20.

22. A T cell, comprising the chimeric antigen receptor of claim 19.

23. A composition comprising the T cell of claim 22.

* * * * *

UNITED STATES PATENT AND TRADEMARK OFFICE
CERTIFICATE OF CORRECTION

PATENT NO. : 11,066,475 B2  
APPLICATION NO. : 16/178571  
DATED : July 20, 2021  
INVENTOR(S) : Blythe D. Sather et al.

Page 1 of 1

It is certified that error appears in the above-identified patent and that said Letters Patent is hereby corrected as shown below:

In the Claims

In Claim 2, at Column 335, Line 40, replace "a CDR-LL a CDR-L2" with --a CDR-L1, a CDR-L2--.

In Claim 3, at Column 335, Lines 58-59, replace "a CDR-LL a CDR-L2" with --a CDR-L1, a CDR-L2--.

Signed and Sealed this
Sixteenth Day of November, 2021

Drew Hirshfeld
*Performing the Functions and Duties of the
Under Secretary of Commerce for Intellectual Property and
Director of the United States Patent and Trademark Office*